United States Patent 10,233,495 (METHODS AND COMPOSITIONS FOR SCREENING AND TREATING DEVELOPMENTAL DISORDERS) - sequence listing, part 172

SEQ ID NO: 1093 - DNA, 4871542 bp, Homo sapiens (residues 3,247,697-4,871,542 of 4,871,542)
  misc_feature (101234)..(151233): n is a, c, g, or t
  misc_feature (321903)..(371902): n is a, c, g, or t
  misc_feature (410214)..(510213): n is a, c, g, or t
  misc_feature (1532608)..(1582607): n is a, c, g, or t
  misc_feature (1864140)..(1914139): n is a, c, g, or t
  misc_feature (3480795)..(3530794): n is a, c, g, or t
  misc_feature (3716115)..(3766114): n is a, c, g, or t
  misc_feature (3938904)..(3988903): n is a, c, g, or t
  misc_feature (4209217)..(4259216): n is a, c, g, or t
  misc_feature (4714402)..(4764401): n is a, c, g, or t
aagaaaacatattaactaatcagggacatggatttcaaaaacactacagaaaaacagaaaatttacccagacagaccagtctagttaagaaaggcaggaagagattttataaacaaagcaaaaatgcagaaatcatacaatgaggtggtgggaatgagacgtcatctccaatataatactaattgctgcaaattacaatgcacttaagtctctcagatgggatagaaaaggaaatgccagctctaatggtttaatgggcagaaaagggtaaaatattcaaagaagtgcacattattatatatatgtatatatgtgtatatatatgtatatatgtatatatatgtatatatatatacatatatatataatttttttttgagatgcagtctagctctgtcaccaggctggagtgcagtggcacattttcagctcactgcaacctctacctcctacgttcaagtgattcttctgcctcagcctcctgagttgctgggactacagtcacaagccaccatgcccagctaatttttgtatttttagtagagacagggtttcaccatactggccaggctggtctcgaactcttgacctcatgatccacccacctccgcctcccaaagtgctgagatcagacatgtgaatgactgcgccaggtcaaaagcagtgcacattatcttagcaagctaatgcagaaacaggaaaccaaacactgaagtttttatcgtttcttaaaggccaagtgtgaactattgtgacagcttagtctgagagttccagatacatagcatggtttttgcccatttgctgggtctttcctctcacatcctaagtgctgaaaagacacatgtggcagggaaagagagtttcttgagcttgccacagtggtggaggcatataggtcatgattggccaccactagagtacaggcacaaaatctggttgcttctctcacatgaaacaaaaggcatctaccactgatgttggagcaaggaacccttccaaccctggcctatagctggccccaggtataggccagctgctgaggtagagttagacacaaaagctgtctatactggacaagggaagacttgcaatcaatcatttgagttggttgcagaccctttcctttaatgaggaaaaactgtgatgtgggtacaaagttccaacatccagaaagattggccttgtccttaaggatattatgttgattggatttctctcaacctccttcagttgtgtttagcattattaaaattaagtgacattcacttggatgaagtggtaataaaaacaagctgtgagaatttctagtgatttttgataccaagccttgtatcactgttgggctttcatgtgtgtacttgaaaacaaaacatgtaaattgttgcactggtttgaagattttaatggtgaaagcaacctaatcagttatgagtaccacatcgagaaaccaaccttggaaatatgtgattatgctcttttaaaatagctgaaaagaaagatgggtgtggtggctcattcttataatttcagcactttgggaggctgagtcaggcagatcactgaaggacaggagttcaaggcctggccaacatggcaaaacatctttactaaaaacacaaaaatcagctgggcatggtggtacacagctgtaattccagttactcaggaggctgaggcaggagaatcctttgaacctggaacttgaaggcagaggttgcagtgagctgagatcctgccactgtaccccaacctgggtgacagagggagattctgtctcaaaataaataaataaataaaatagccaaaaaaacctgactgtgtgtttattctcactttgttcttgttttgttgtataatatttaaataaaaggagattatttatcctcatactgaatttccaaaactgatatttgcatttagtattttgttaaatgatggagagaaaatttaattgtcttactttgaaaagtttggcataggttctgtcacatttttgatgctttcggtcacagttctgtcattagaatgctggcaattagttacatgcaaggagtatcctaaccactttaatacgatggtttgaagtgctgcaggcagtaactactggacagcagatcatagtgtttttatcggtgacacgttagagagaaatagaactttctgcagtacaaatgtcctattaactaatccttatgctattagcttacagggctttgtctcctgggtctgaaaaaggcagcttctcctgctaaatcctgaatattgacaccaattaatgccttgtcttcagactctggggaagatgacaaacaaaatgaactgctttcacaagacacagaaccagaaattgaaaccattcaatccctttaggcccaacaatcccacatgtcccgttttccacctcatgccccctcttcctctagacagaagaggtgggcacgtgagaattgtaaggctggagtttgagggataagtttagttcagagactttcttttctttccctttctttcttttcttttctttcttctttctttcttttttttttttttttttgtatttttggtagacacaatgtttcaccatattgcccaggctagactcaaactcctaagttcaagtgatccacgcactctggcctctcaaattcagagattttctataaattagacattacagtcaggagcacactgatgcaaggccaacatctgggctcgtgtattgcaatatcagggttttctagagcatttatctactccttaatacaaaagtataaaaggttatgaaaggtttttggaactcttacctcatggtcaaactgacttttttttttaatgcctccttataatctttttaccaaaggtatattttagttttcttatacaccttgcacataaactgtttctttaatagtactcaggaggccttattacttttaaattatacaactttgtttgcataaaatttttttataactttttttctttcacgacttccgcagacaatttttcaacatgtctcaactttctgacttattacaaacacttttttctttaaacaaccagttaatttatttcaggacaagaatttaccacataactttttgtttgtataaattctgcttcctccttttttttccttttttaaagtgaactttctttatgtctttggatagactgtctaaggccacaagattagaagttaccataatacatgttacactgttaacttttagcaaacttcacttttgtagaaaaccttgtaagtttgggatttcaattgtcctttgctattaataagaccttgtttagtctaaattaacttagaattggtatagatggcctctttttctctctgatggtctttacttgcctctgccagctgcttatgctgctgttctcttaactactgcgggcagggaaagggggtctaaaaccagctgtaactgtccatgtacggaaactggtctgggtgccttggcttagaggttaccttatgccatacctttgaaacaagggacctgtccaggcttccttctgatggccaacctacatctaatgctggccagtctatttcacataaagttctaagtttttctggagtcatagtgactccatagtctccattgaatcctttcttgaaattttttaacatagttcctagtggggggggcttatttgtgcctgacccatgtttcttcaagacaaaacaccacgctcacaccacacgccacacaccacaaaacaaaaaacaggtaaaaagggcacacacacacttctgcagtttacaccaaaccaaaatcaaaaccaaaatcagagtatccagaaatccaagccaggtcaaaaccaaaaccgaagtatcaggcaatctaagtcaagtcaaaaacaaaaaccaaagtgccggtacaggcacactgtgggtgatcaggccacgcttccactcaaatggagtaggcaagttcccaagaccagtcctgtcaagcaatttaaaccaagtcaaaaccaaatccaaagtgccaataaaggcacgctgtgggtgatcaggccacgcttctactcagatggaatgggcaagttcccaagactagtcctgtcaagcaattcaaaccaagtcaaaaccaaaaccaaactgctaataaaggcacgccgtggttccactcaaatggagtgggcaagttccaaagactagtcttaccaagtttcagatgtccggactccaagtgccagttccttcccggtgttcagccactgtgttaatcctccgcgggggcctgctacgcattgctctggcaaggcgttccaccggggcaattgcctaccccgaagcgctctttggatcatgtcactcaggctggccgaagtctcccgcagagacgctgcacagcgcaggcttaagccgcctaaggggctgccttggcagtctgtcagtcacctcgcttcccagtcagggaaccaagaaaggtagcaggatgagtcgcaaacaaaacctctcagacacggagttgtagaaggaagggctttattcagctgggagcatcggcaagctactgccttaaaatccgagctctggtcaaactgattataattaaacttgtgtataaggttttattaaaattagctttaacattttaatacaccacacaaaggtaaaatttggttttctcttttgatcaaaatgtttgtgtagtattaataatagataaaatatttttgtttactttcaaagtaaactgcagggcaaaagaaggaaggggagagacacatacacatggcctcatgttgtcttcattagctcttactgtttagaaaactcagcctcttttctagcaaagggtgaacatttttgttttatcattttggctaaatgattgactatactaaggtgacctgtgatcctattttgtgatgtcaagtgtctcaaaactttgatatctggcaaactttctaagagtaaagtttctaaattcaaccctttgggcctcaaattaactttttggatattaggttcttgaagtccaagagagatatattaggcttcttagacttatttgttatgtagaattatgcaaggagcattgtcaaatctgaggtggtgtttcacttcctttgggttctattgacacagatgtgttgttaatgtgtgttccaggattgtatgagattcctagagttctgctatgctgtcagtaataattatgattattatgttaaattgttgtgtgccacagaaacaacagaattcccttgtcaattgtatctataactatggctgtcttaaggcttttgtcatccacaattgttgttttgctttgattcttcttaaaaagtgacttataatcagttacagtccaggcctttcttctttggggaagtccatgaaaaggactcttggatgcaggactcttctgataactttggagattgtgccactgaagtaaagagaaaatttccagggcactaatagaaagacggatgtgttcatagagattgctaccccaatgtgacgcagagcaggagttgattgcatggattgaactaatagaggactgaaataagtttttatggcctttgtttgtttcaaacattgttgattcttcagagtctggagaacttgtttccttttgagctatttatagactgcaacaattgagtagaatcgtcttctaaatagaatttgaggcatattgttctctctctgacgaatttctacagaatttgtaaactgaatattcttaactcatgacaatgtgtttgtttgcatgagttcaataagattctgttttcttttataatgggacacaagtggaggaactggtaattttcccagggctttgcctgaaatggtgttgtgaaatattccagcaaagcctatttaggagagcctatatgaacaaggattcttgctgcactttgtgtgggtaatcaggccaagtatatgggactgaagcttcttttgcaggtaggttggtcctgctgtgttttgtctttagtggaagtgagggactggagagaggaagattgtgtttcaggagaaactacagtattagatgaatgtttgattcctgggtggccatgcagtcacccatggtgtggagctgctcaggatgcccctcctccacatgatgcagccagaaagatggatgatcagattccccatgattgaggaactgacaaatagaaagtggggactgaaatcaacccaagagtcccacagacagtgtttttggatagacatagaaatggacccttctggtcttaaagcttgaaacttaggacatttgttttatctgagttccttcctcagcaaaggcctctcaggcctctcaaaaagcgtcatagacctgaaactcagcagatgacagcctccagacaatgagatgccagacccctcactcatcatgagtgcttcctcacccttccctagttcctcttttcccacccacagttaacatttcttccctgctacataaacccctcactttagttgatcagggagattgatttgaaactgatcttccatctcctcagctgcagcacccaattaaagccttcttcctcagcaatactcaatgtctcagtgattggctttctgtgagctgagtagcagggcctagaccgaactcccgggctttcagtagcaatacatgtacacttttaaagactgtaattaatgggtcatgatatattgacaaattgtaatggtatcaacttggccaattctgagaaaatacactgtgcttcaatatcagggccctgctcctgacctcgacagtatatggctgattttgagtcatagtaggagagtatggcctggtttgagtgttttatagaaatgtaaacatggctgattgcttttattttaaatccaacaaatctccatttctggtgagaaaattttgttaaaaccaaccaaccaacgaaacatagaagaatatgaataaaaaaataaaggattccctgcttcccaatctcacttgattgctgtcttctattatatgctacagggaggaagggggcaaagtgcccaggaagtcccatgtcctgttttgacaatcatctggcctccttgggcaaatggaaaagagggaaagcatcaagaaaataacagaaattttgcagatatttcatctccgggctgggtgcggtggctcacacctgtaatctgagcacttcgggaggccaaggcaggcaaatcacttgaggtcaagagttcaaaaccagcctggccaacatggcgaaacctcatctctagtaaacatacaaaaattagctggacatggtggcccacacttgtaatcccagccactggggattacaatcacttgaacccgacagatggaggttgcagtgaggggagattgcccactgccactgcactgcactccagcctgagcaacagaaggagactctatctcaatgaaaagaaagatgaaaagaaagaaagagaaggaaggaaggaaagaaagaaagagaaagaaaggaaggaaggaaggaaagaaagaaagagagaaatttcatctcgacacaggaaactctgacctaggctttaaggaaagaaaagaaagaaagaaagacagaaagagagacaaagaaagaaagaaagaaaaagaaagggagggagggaaaggaaagaaggaaggaaggaaggaaggaaggaaggaaggaaggaaggaaggaaggaaggaaggaatgaatttcacctcaaaacaggacccagactgtgtcggtcctgaagcctctgtgaccgaggcttcaagggctcttctctggccctaaatccacagtggattttgccttattttccgaggtgcacatgaaatgatagaagtcgatcaaaggagagggcagagagaaagcaagagggctgggtccttcctgcaggtccaccttcctcaggtattgcttgtgggatcaaaagaaatgccttgacatgggtgggtgggaactattgatacttattaggaatccacacacctgcagaaaacttgcattgtgaggttccatggtgtaatggtaagcactctggactctgaatccagccatctgagttcgagtctctgtggaacctttctgtgtaactgggacgataatgccgtcttttactccctaaatggaatggggattccgctgacgttcttcagaagctctgcgctgcgggcctccgtgtcccttctactcccgctgtctgaaccccgcgatgtcccccgcgctgttcgtcccctcttcgtctccctcttcgatgttccgggtcccagaaaccaggttatcacagtggcccggatcatagggaaattgcgaaatcatccagttgggatcaccgagcctgcagggtccccttcctgggcgagcctcctggccccgtgctatcggaggcctggacacccccgccagggacccagcgacccagcaagtccccaccccctctaagggcgacctgggcctcggggtgagaggtctcctacactaaaaaggctgccgcccttcaatcctagaccccgagattcctttcactcgggaaatctcgtaatggcatccattgtcattttggtaagtaaatggcgtgagaaaatttgatggggttagctcagtcattggaaattgtgtctcagtttacgatcgatggtttgagacctaacttgggagtagcactgttttattcagatggcccatcctattccgaatgttaatttgctctgttcttcatattcagatctttatgccgaatttctagctcctgcgtctccattgccggtcctaaaagtcgccgtttcactaagcttcggaacctgactccgagaaatctattcgttcgtcccaagatctcagccagaaagagaaatccgcgcggcggcctcttctagctcgggtgctgggaggccccgtcctgatcctctgtcgccctggccgatctccctcagggccacggggaagaggaacctgagcagctctgaggggcgagtctctgacggtggggctccccctcgtcctgccaggaccctgccccaaggagaagaccccttaggacgttaccagatttaaacaatgttttctcctgctcttcagagcacctgggataaggttcctgatgggtcttgggagcaaactaacatgtcgctccaggcgctcaagaccatccctctgattttcatattttggggctgagagcgtttaagaaggactgaaaaacgctgcagtctttgaggggctaagtttggaggatgcgggagtgggagaggatgccttcttggctccttggagtggactggcaggtaaggaaacacaaactccgtttccccttgcaggctggactgcagggcctgggatggaaaattggaccgtcaaagagtaacagtatttatgtagaggttggctgcattcattaaaaattgttatccctacagataagtgtaggaagggaccagggcactgccgttcaccaccagctttgcagcatatgtgactttgaaaacagtgtatagtgcataaaaattcatccctctttacaaataattgatcacaaccagttacagatttttttgttccttctccacttccactgcttcacttgactagccttataggaaaaaaagttatttgtaaatatgatattgtttcagttgatcctcagcccgcccgttccccaccccctgaaagtagctggaacaacaggtgtgcaccgtgtgctgggctcatttttgtatttttagtaaggattgccttttgccatattgtccaggcagctctcgaatgcctggactcaagtgatccgcctgcctgggccttcctgctcctccctgctgggattacagctgtgaaccaccccacttggccatcaattgtattttgaatttaaatgttttatagtcatcattcttcaaatattcttggttttgttgcatgtgcatgatggggttcaggacatgctaccccaaaatataacatcttggggtattgaatattttatgttaagggaatttgaataaacaatagaagcaggaaggtcactgtcaccctccccctgcccttctttcctgaagtcgattatagacccttatgtgagatgtgccctctctgtacccagaggaaaggtgcatcctggagtctgaagacacagggacacagagaagagcctgaacacagaggcctggccccgttttccccagtttgttactgttagatcatacttttattgtcttatcatacttctccatgactatccattcttcaataaaactactcttaaaaaacaaacaaacaaacaaaaaactgaggtttagctgtttccatgggccttcatttcctttggaaggcattcctgtcatgtaaaacttacattaaataaatacatctgctcttctcttattagtctgtcttttgctgtgagggtctcagcagtgaacctaggctgggtgaggaaaagtcatatttcctccccgacatgtacaaatgtctttgactgtaaaactataagaattttactggggcagatttgaagcaagaaattgcatcattattcccctttggatgagctgaacagatgagctaataaactcccagttccccccagatagaaatacttctctagctcattccctgaagctcctagagggtcaaacctgctggagattaaggggccttcctgggatctcccagcccaggaggttactgctggtgagaggattgctgcagtctccctgggagggtgcatggccattggaaagtatcactgctgtaacttcagtacaactggttttcatcacatctgctctttgtgcagtgttgcaggcaaaatacaagagctaacatgcacatgagaaacacatgcacatcatcaactgtgcctgcaacacaaagtgccacatgtcaggcacagttgatgagtgtgcatatgtttactcatttagtccttacctcaggccgaggtcacatcatcaccttcatcttccatatgagaaaactgagatgcacaaagatgttaagtgacctgtccagggtcactcagccagcaaagaagaatttgaaagcaggaatttgaagtgaagacagcctggctccagaagacattctcagaaccactgtgtttatactgctcctaacaaaatcacccttgcaaaaattatgacagtgagaaaaacctgacataggaaaactatgactgtgaaagaaatctgacctaactgactgcatcttgcttctaatctctgagctgcccttgtccattcctgggaataggccaggctaactatgagaggagtttagtttagtctaactctgaaacaaagatgattgtcgctcctgagacaaaccccttcctttcttggggatcagacctccttagcaaagctaacaaattaggcacgagattggaatttatggctcaggagccgtgcagccagaagtcacatgattcctaagctccccaattgtgcctatatatagtattattagtgtcaaacctaatattggtgtttaagatatttttcagaccctgccttgtgatggactagctggtaccactcagactggtaaactggctcatctggtcctgtggccccatccagggactgactcagtgcaagtaaacaagctcttacaccctgtgatttccaaccaatcagctttgcacattccctagccccctgcctgccaaactatccttaaaaaacaaaaaaccaaaaaccaaaaaccaaaaccaaaacaaaacaaaaaccctagtctctgaattttgggggaggcagatttgagtaataataaacccctgtcctggtccctcagctgcatctgcatttgttaaattctttctctattgtggaaagcctgctgttctcagctccattggcttatctgggcaatgggcagaataaacttaccaggcagttacactaataaaagagaaacacaaattgtaagcatgcttcaaaagaaatgttaagtctttgtatttcttttaaagaaacacaaaaggaggaggaatgataagacaggcaatacactgtcctaaatattttcatgattctcctgcctccttcatatccttcttatcccaacaacttctccccagaaaccttcaacttaaacatggtcctgccagaactgggtttgtccttcccttaacattttcctctcacctgccctacaccccttccaaatctaatctgttcattcacttccaggtcattgaggattttccatttaaaaatataaaaaattcataaagaggaagataactggtcatccatattcacacctcctggaattaactactgttaacatatctacatatttttcttctgaatcatttttaagctattgtctttttttaaaaaaatttatacatgctaagcatagaccgtactaacagtagagaaaatgtaaacatatgtaaaatttttgatcaccttaagttcaaaaataacttctcataacattcgggcaacactggagtcatggtattgtgttatatctacagagagaagaaagtatattttagctagactgttccccccaggccccacaaaagaaaaaagaagaaaaaaaataaagaaggatatatatgcctgaaaaaattataaaattataaaaatatataaaatatatatttaatatataaaattatatagtatatataattctatatttaaaatataaaaatatataaaaacatatatgtatgcttttataaaattgagcttagactctatttttattttacaaatattccacttaatagtgcatgaacttaactgcagacaaagagacagaaacagaaatgaaggaattcctgaactccctagcacagttagaaagacatttgtctaaacgactcctctaagggcaaacatacattaaattaaggagaagacattaagatttggagtggttttcttattcctttttacaaccaagttaaggtgtgagttgcctatggtacaatgcatccatttcaagtttgatgactattactctaaaaggtcctcttgtgccctttgcagtcagtcccgccctccccctggccccagcaattaatgatgtattttctgtcactatacaggttagttttacctgttctagaaattcaccttgatggcgccacacaggatgccctcttttcatcactcggcatgatgtttttgaggtaatccatgctatctcatgtttctgtaatgtgtcccattttattgctgggtagttggggtagatcgccgacacattctgccgacaagtcagactgcggttctgacctgaaggcctcggtgaacataagcaagggcacctgggcgcggggagagccgttcccctacagaaagcaagcgtgttgtgtctacaaccgaacagggacactgctttcatcccaaagaacagcacccgtctgcctagaatttctacctggctctaggaggtgagaacacattccccgctagcacagaaatcctacaaacttctgtgggggctgcggttagaagcacaggctgtgtgaaaggtgactccgggggctacgaaaaaacacgaaggttttcacatagggtgagaacccaagacactggagaccatgaagcaatcttgaaaaagcagccccacgtggaaagggaagagaagagcactggggccacttagcttgcgttaagcaagctcatgataggggcggagaggacagtaacacaatactttctctttcttatgcttgcgactgtaggacaacacttaacatgccagcaaagctacaaacccgtagaaagctaagtagaaactaagagtagcccttcctgcagaattcactttttgcactgcaagatttcagcggaaagcactaacgcagttctccactgttattgtgcagccaaatttctcccatttgggttaatcgcaggatcagcacgtccacagtgcaatggaaaagcaacgccctgggaaaacaaccttcataacgtcctctgcgatgtcaggtaattaggagttcacacgtttccgtcttgctactgctccacacgcctcaccctttttacacacggtcacttgccccgcgcaccccggagcccttccagccttgacacacagctgggactttcaggtctgaacagcggtcctggacttgctcccacagcacgggaactccttcgtagcgaagcagccggtggcgaagcagcagcccctgtgctgcctcatctacatagaagtcgccctatccgtgatgtcactgacagcgcctttcccgtccggctctgcttttccgccccaccttctgccactcagccgaccaacatgctgccagagactgcggggacagtgacgtctgcctttccttcctttccctcccttccccgccccaatctttccaaagaagcaggtgtttctgttgtagttttttgttttgagccgcagtctcgctctgtcgcccaggctggagtgcagtcgcatcatctctgcttcctgcaacctccgcctccagggttgaagcgattctcctgcctcaggcttctgcgtagctgggattacaggagcacaccaccaagccctgctaatttttgtatttttagtagagacggggtttcaccatgttggccaggctgatctcgaactcctgacctcaggtgatccgcccgcctcggcctcccaaagtgctgggattacaggctgagccatcatgcccgcccagaagccggttcttagcctgtgttgccgatgacctctttggcagacagctggaggctgtccacccttcttcaaataatggtttgtaatgcgcagactaaaacatgtaggattacacaagaaactggttctcttcccatcgttattcttctgatgtagcattctacttgaaattggaagccgttcagtatcagagagaaaccatatctatgaaactagagatgctgctcagatgactgcaaaccagccatccttacttgttttaccattagtagtgctataaagacggtggtccaatttcatgaatcttgtaggattttttcaaatacagcaatgtacaaatatgctgccccagcagagcacactggacactcgggcatggtgctggagtttgtcatctcttccatggccttctgtagaccgtagcacttacctcatgttagcactttatattctgcaaagagagaaacaagtggtccaaatttggagaaaaaaaattgggggaaattttatttgaggtgcttaactgattacttttaatttgtagaatacaatcccaaactctgacaatactccacagactccaaatctatcaggcaagtttttcctgtcctttgctttcatataaatcaaatcataaagtgtgtagtgggttttgggggagtataactgcgcagtgggttcctgttgcctgctgcctagacagaaccaatttatcaagacaggggaattgcaataaagaaagttgtttacccagagctggctgtgtgggagaccagagttttattattactcaaatcagtcttcctgagcattctaggaccagagtttttagggataatttggtgggtgggggacagtgagttgggagttctgattggacaggtcagagatgaactcacagggagctaaagcatgctcttgagctgggtcatttcctgggtgggggccacaggatcagatgagctggtttatccatctgggtggtgccagctgatgcatcgagtgcagggctacaaaatatctcacaaaccgatcttaggttttacaatggtgatgtgatccccaggaacaacttggggaggtttagaatcttgtaagctagaggctgcatgatcctaaaccatgatttataatcttgtggctaatttgttagtcctgcaaaggcagcctagtccccaggcaggaagggggtttgttttgggaaagagctgttatcatctttgtttcacagctaaaccataaactaagttcctctcaaagttattttggcctgtgcccaggaaagaacaaagacagcttggatgttagaagcaagacggaagcagttaggtcagatctcttttgctgtgataattgtcccagttataattttttcaaagtcggtctcaggagcagaggcataggtttgatttctttcactcagtcttacatctatgaatttttcatgttactcatgtggttatttgtttctgtgcacaatcctttgtatgaatatcggccaacttatctatttattctactgttgctgaacatgttgacctaaaagaaagaggctgaatcacaaaatagaatctagagtttacttgagccaatgtgaagacagctgcctggaagactcacacccaaagaaccttggatctgagctccctttggcctttgtcacaagcaggtttttaaaagtcaaaagggggggatgcacaatgggctgatagaaaggtgcccgtcaggaattctcattggctttcagaaatagcattgatgagagcttggctatcccttgttatagggtgtgggatacagtgtttggtgtggcattattagattaatttacagctacctggggtgatagcaagcagtttcaacagatgaatacatagctcaaaaagaaggaagcagaaagtggttgctgtcttgatttaatgtctctctgatcatgtgaagtggctcacattcctcagataaaaattctttaaaaaatctttcttcttgaaagcattgatgatcaaaagctcagccaacgtgtccctctttgccaggaaagctcattcccagatagtctttcccacggtgagggcaggggaggaaaggagctgcctcactgaggaatttttaagagcacccaaaagcccaattgaaagggtgacaccgagtagaaaaaaaagaaaaagagaagaaaagaaaaaaaggaggagagagagacctcagttaagtctgcagctatcactcgttgaatcatttctagtcttcagataccataaaatcagttttctcagaagcaggaaatatatagcattaattatttgaatagtacacatataattcacacaagaatgagaatcacaaagagaatctgtatgccagaacagtaagggaacctattccattagggagccaacgaaaaacatcagggaaaacatcacatcccagttcttctttcatgatttcttgtagccaaatgacttctaattttttctagatgaggttctacttcatgggaagtatttatttatgtatatgcaacaagaggttgtaaacaccacacatccacctccctgctcagctaaatctatcatctaaagcgggctgcggaggctgctgttgctggggctctccccttggtgttctgggctgcgttgtactaagtggagaaggtggttgtgggcaagcgttgtgcatagatcacaaccaggtgggcagggggctgctctctccacactatcagttgacaatgtacaattccttttatgaactcttgtaagtgctgctgtatctacccattgtttttgttttgtttttatttttttgagacagagtctctctctgtctcccaggctggagtgcagtggcacgatctcggctcactgcagcctctgcctcctgggttcaagcgattctcctgccacagcctctcaagttgctaggactacaggaagatgccactgtgcccagctaatttttgtatttttagtagggacggggtttcaccctgttggacaggctgatctcaaactcctgacctcaggtgatccacccacctcagctgcccaaaatgctggcattacaggcatgagccacctagcccaggttctacccatttttaaataaggctaatagtgtctttgaaaatatacatcatctaaagtgacgcgattatctagtacaaccttagccagtgaatgaatagctttttgatgagctgtgaaagaggctacagtttcatcagcaatacctttctttctttctttctttcttcctttctctttctttctctttctttctttctttctttctttctttctttctttctttctttccttctttctttctttttctttctttctttctttttctttctttcttttttccttttcttttctttctttctttttttttaagacatggtctcgctatgttgcccaggctagattgcagtgatgcagtctcagctcactgcagcctcaacctcccttgctcatgcaatcctcccacttcagcctcccaagtagctgggattacactgacgcaccactacccccggttaatttttgtatttttttagtagagacggggtttcaccatgttggccagggtgttgaactcctgacctcaggtactctgccctccttggcctcccgaagtgctgggattacaagagtgagccatcgcgcccgattcttttttgaatgtttggaagagttcggctgtgaggccatttggtcccgggcttctctttgttgggaggttcttcagtccttttatttgttattggtcgttcaggctttcggtttcttcttgattcaatcctagtcgtttgtatgtttctaagaatttatccatttactctaggttatccaatttgttggtatagagctgttaatgatagtttcttatgatcctttttacttgtgaggcttctgttgtaatacctccactttcatttcggatgttatttatttgagtcttctctatttttttcttagtttagccaagtgtttgttaattttactttttccagaaatacaacttgggtgtgagaggcctacgttgcatcaccactggaggccagtagttcccagtaggcctgggaagaatagtaagatgttgtctctcctaaaaagagggagaaagagaaaggaaaaggaaaaaaaaaacccaacaactcagttttgtttatttttctgtagtatttctattcttcagttgattgacttctgcatcgatatgttgtttcctttcttcactgaactttggatttattttgttgtttttttcctggtttcttgaggtgtaatgtttatttgaagtctttcttcttttttaatgtatgcatttatggttataaacttgactcttagagctgtttttgctgtttccaaaagattatgttgtttgttttcacttttgtttgcctcaatcaaatttcccttttgatttgttctttgatcagtcagttgttaagagttatgttgtttaatttccatgtatttttgaattttccagttttccttatgtagttaatttttagtttcataccattgtggtcagaaaaaataattgatcggattggaatcattgttaatttgtctaagatgtacttttcattattttaattaatgtataatagttgtacacattttggggatacacatggtattttgataaacatatacaatttgtaatgatcaaatcagtgtaagtagtatatctgtcacctcaaaactttatcttttctttatgttaggaatatcccaattcctctcttctagttattttaaaatatacaagaagttatttttgtatatactatcaaatactagaacttattccttctatttaactatattttatatgcattaaccaataccttttcttccttctctcctgtctccttctcagcccatctccttctctcagcctatcccctatctccttctcagcctcttgtaaccactaatttttatatatgatatgacacatgaattcaattttttctacttgtttatttttatatagttacaaatatgttacatcaattgcttaaaaagaaaatcctcaatcatttgttgaaatattatgtatttttaaatacattgcttttttaagattgtcaaaaatctgttctcaatatatgtattggtttatatttggactctattttcttttgatccatttaattgatcacataccaaagctctgttgtggccattacaactctgtgattgttctttaaatcaggtggagctagccctccaattttgctcttcgttatataggcatttttgttatgctagttcatgttaattttagaatcagctgccattttctaccaacgatgcatgctgaaattttgagtcagattgcattgaatttatagatcaaattaggggaaatggacatctcaacaatattcttacacatgaacaaacaatatctttccagttattaggcctgcactatgttctctgtgaaatatgctctaattttcagtcatattcacatttatggattttatacacttgacattattgtaaatgatattccttttacatttaaattctgccgtgcaattgcataaatacaatttatttttgcatattgatcttatatcctgctagaaacaaatgctttttgaattcaggtttgatcggccagtggcagtatctttggaaactttcatatttaccaggcatgaagaatctttctcatttcaattggacctttatcaccagcccaagggagaggaaagtcctaacgcatatcaagttctgaggttgggaagagttgtactttgtagataaatgcatgtgaaatgttctgtatgtttgccaataagttttcattaagattactcatgcagttataaggctgcccatttgcacttgtgtttagctgcaatactatagttgtaaaatttagaagccaatgttctcccttagtttaaaatttaatattcaagaatttactccagtattatgtagtgccagaaactttgggatgatatgcaatgatatgtccagcaagtatgagtttgtacctgatccttattagtcttccttctgatgtgatctattataaaatgagaccttaaagagctttaaaataattaataatggcatgctgaggagattagtttgtgggatattcagtagccataggaaacagtagttcctactctgtatctcaagtgagagtccactcttcagtatgtcagcttcaagaccctgatctgcagtggaatttgcagccccctgctgtgtcagcttcattacttcaagggagggtgaatgccttcagttctttaggtcacaattgacacatgtagcacattttggtacctcttcagttactgacctttatgcccactcatgtcaggcttgctcacctgagtgattcacaagatcacattcccaatgcatcagatcactgtgtcacaaaaaaccaaaagcatttatttgtcattatgtatctctcctgaatttcaaccttgataggctaacatggctcacaaacagctttaaatttggcttctcaaatgtctgtctaatggtttacaaaagtccagttactcaaatgaatttatcttacagtccggtttctattgttccatgctgtgcctcagtgacataaaccaagagtcagtatatacaaagatttattcccactggtttataaccaaccaataaatagtatgcctgttatatatagttctgtgcattgggttgccagtctccttccttcttttacctgattgttattggaagtggagatgatgtaatgttatgggtcacttctattagcgtccctggactacagttctaccatctattttttaagctgttttaccttgttatataagatctgcatatttagtagcatcatttatgttattaatagttaacatctatggtagtcacttctttggttaggtcagagactaaaatctgaaaattagaaatccattctttatttcaggtgtgtgcatgctgttgtgttgatccctctcctctcccagaaaagtcattgtaggcccaagttgatgaagggacagactgtgaaagaatggatgcagagcatggactaagtatgcagtgcccactgagttgaaaatgttgctaaagttgcttttctgcgattgtctaacattcctctgagtcacctcgtctgctgcttaagaaccccaaagcattttcttcactgtcttgtggccattgttataaactccactctgttcttcctgtgtcaactaccacacagtctgtttcattccatggccctaaaggcagagccatttttccaattttaggtacactaagggtatcctgtttctgcaaaaccaatggatgttagtggttctcttagttgttgttgttgttgctgttgtttttttttttttgacgtatgaggccataattggagtaatgtgaaaaatattttttcctccagaagttattagatgctgctatatccaatatttgttctatcagtacactataatgtatcccagctatgcattttatatttcctaaaacttcacttctgagaaggcccttcacgagtttttagaaattcatggcccacccagcagcattactaagtcttttggagtctagcctcatggtctttctgttgattttcctgctgtcaacatgtaatctgtgaaatgaaacaaagggaggggatccaggccaagacttggcgacattcatttatgacagtcagtagtcagacactatgtgcagagatcctccagatcctgtttgaccagcatctttgggaggttaagagcccagccctgtcagaaccactattcattatcatcgaccctttcaccagaatgcacctgtgtgtcggctactgattttctcacctccaggcaactcaggctgagctgggagcagaaatcttaagctcttgtcactaaggactcttctgtgcttcctctgtatcacccgccataactagcataatgctttactcacaggggctcaggaaatgcacttgttgagctcaacaaattgagaatccaagttgcctgataagcagagatgttatggtgtagagaattggatagggtaagcagaggaacaaaacaggttgtcattttgttgttattgttgttgttgttgtttcttagagtacaaaaattgtgactggcaactgctggggaatcctaaggcaggactttagtccctaacccccctacattctcactacattcatggaagctgctttactcctttccaccttaggtatttaatctataattagaggataaaatacacaatttctaaatgctagtactatgactgatatagaatttattttggacacaggtgaatcttgaagtctgcaaagcatttcaattaccaaacagaggccaggcacggtggctcatacctgtaatcccagcactttgggaggctgaggtgggtggatcacctgaggtcaagagtttgaaaccagcctggctaacatggtgaaagtccatctctactgaaaatatagaaaattagccgggcatggtggcctacacttgtaatcccagccactcaggaggttgaggcagaagattcacttgaacccggaggcagaggttgcagtgagctgagatcatgccattgcactccagcctgggcaaaaggagcgaaactccatcacaaatatatatatatatataaaagtagacagaagatagatcatctgtgattactatgtcaaggacaattttagaattcttgttaaactcacctctttcttttcacagctggccaggacttagtcagtatctactgaaaccttgaatatcttggctgtgttaactgttttgacccaacatggagcgaaaatgttggttgtaccttgagattctgacatctggttgaagtccaggttcactggcccaggacaggtcattcagctgtttgaaaaaaaacagaagagagaccaggccatccactgaggtaatctccatgcagcatgaaccactggttccaatgaacccaccatcaccatacttctcaggaatcgctggtcactagactgagagttctgtgaaagctgagatcatatcttactaatctctgtgttcatggttcccagctcagggtctagcactgagggagttctcaggagagtgttcatcaattattgaataaaagcgattgcaaacctcctctcacctgcattcctgtcccaaatatcctgtcagggatgctgagatttctcccaggatgcagcaaatccctttccttagactggcccttgccttacaccattcatgccccaggatccgtctctgtgggacattagaggaaaatgagtctgttctgaagaagtcctcttatggttccccctgtcgttaggagcaatgtcttcacctaaactcccactctctgggttgccacaacaccccaatgtgggggaacttccatattttcttaaaatgctatgtttctgttctttctctcatgggcttgagttcctttggggagacattaatatctgaatcccaagtgtttaacacaatgtaaagaaaattaaacacccaataaatatttatgagatatcatttggaaacctccttcaactgtaagtacagaagaatattataagtatcactgctttgtatactagcaagggacgcttactctggcacctgacctagggcagagctttttatgtaagaatggatgtctccaacccttctcccagcatggttattccctctaacccacactgacctgaagagcatccactgctatggcagccccaaggtcaaggctcctgggtctggggcggggctcatggtcgcatcttccccccttggagttgctgctgccccctcactataaaccagctctgatccaccctgtggctctccctggccaggggcaggagactcctgtggagtaaatttctctctcagtccccactgctcagctcacgctactccttgagggcttggatgatgataggcattgcccatttcccctgaggcttctgtcccaatttgtccttatttcccccttctttggttttcatttaccaatggcttgtcctttgtgggttgttctcatcccctaaacctgctgactttctttctttcatctgttccctcagttctgggcttccagtgtagggactcagctcaggctcctgcaggagacacacagagtcaggtctcagctgcaggtcctgggtggcattaaaaaccatctcagttcctcagagactcagagaaaacaaagtaggaagggacctcagagaggaacaataagcccctaactcactgaggaggaaagtgaagccaagaaagactaagactctcccaggctccctcaccacatggtggcagcagatcgaccacacaagccttggcctcagcctccaggtctaaagcagctaactcaccctccaggaactcactgctgtgtttcagaaaactttggatcaaaaacagcaatttccactgtgaaaacaaataaagtaaaagggcttttccttggacaaacgctttataaccgttctacagtcctagtatttatgctcagtcagttgtcattcactggctggtagattggggcagggagcacataaagattaagtaatgtttaacacaagcctgctttcccagcctgggatctcagctcctccattcttcagggagtttcctctcctgaaactgctggagagtctcagccctcatgtgggtcatttctccatgatgatacctgttattttcttcctctcctggagataagacagggcagagattggttctgggtctccacaattctaggttttctcctaaaccagccaggtcagctggaagcaatcatgacagagaggtcaggtcagtgaagagggtcccaggggagcagggggtcacaaggacagcccctcatggagatggtcaggaccgtgacatgggcaacatttgaccaattctgctggggataatgtgccaaggattaaggggaggatgctgccataagtagaaagaggaagaaccaaaggagtaggagaagaaggaaaataaaatgatttctataaagatagaaagaaaggcagagcccagaggcaagccccatgtcacagagggttagttccaggttttggatcctaaccaagaaattcctgctggactttgctcagcccaatttcaaaaaagttttggatcagtgacttctttgttacttccatgtttcccctttgtgaacaagaatcgctagaatcatttttctatgtctgtcccaccattgcacacagagggcagataagccgtttgttcagtttcacaggttgatagagggaagggaattatgtcaaggatctggacttaatggacaccctcagaagcctcattcacacttggtatagttgactaagataagattttaaacttttgatctggtgtggtctacataacatttttcactttgagctaatgctttaatgacatgaaatttggaaaccttagagtagagggtgaatgtattttgcaaatgggggaatgtgagtgtccgactgtggtagatggaatttctgaaatggcccccaaacatgccacacccttgtctctaaagcctgttaaggtgatgaaacatcattcctgtgattatgttgttatatgccagttatatgactttaagatggtgaggttacctgtgtaaactggatttaatcacatcactgcacacatgccagtggtttctctagctgtcaggagagggtgatgtcagaaagaaagggagcttgagaaggactccatgagctgttattggttggaaaatggaaaaggccaggtgagaaggaatgcaggtggcctctggagttagagcgtctcctgcctgacagccagcacacaaaaagaaaacccagtctttcaaccccccaaaaatgaattcctcctacacctgaagtgaacttggagaagtagcctgagctccacataattacatagccagacacacctggattcagcttcctaaaacccttatcagagaacccagcctctgttccagacttctgtggtttcaatccactagtttgttgcatgtgttaataggcagcaatagaaaactggtacagatgcctatctctactcttgatttattatttcagatacatggaagctaatccctctaagagaaaaaaattaaagagcaaagaactacagcaaaaatcttgcgctcacgttcacctttatgtcactattctggagcccttgcaacctgaagaagataatgagaggcattccaagcatgtgaggagtatctctaatgttaccaaccaaatttctgaaagaataaagatggtacaatactaactccacataatcttatgtgcaaattcatcatctatctctatttcttatagcagatttctttttcttttttagctcattcatttaggcttgccagatgaggtttggtaacaactatcagttatcagcaaaaatgaaacaactaatgaagagcaatgaacaggactattatgttcctcaaaaaagtccctaaaatgcaatatttcctctaaatgtcacaaaagtaagacagtgattcactattaaaaatcctaatctaagaaaggttgaaatttaatgatgttggttttccaaatttttattttgttgtggcccagtcatgggcaccagagattaggaaatgactgtgcagaggcttgagggaatttgggaaaagacaaaaatattctaaaatgtgacactgctgatggctgcgcaattggtgagctttattacaagtaagcttttttgtttgtttgtttgtttgtttttgggggggatagagtgtcactctgttgcccaggctggagtgcaatggtgtgatcttggctcactgcaacctccgcctcctgggttcaagtgattctcctgcctcagcctcctgagtagctgggattacagggacatgctaccatgcctggataatttttgtatttttagtagagacggggtttcaccatgttggtcaggctggtgtcgaactcctgaccctgtgatccacccacctcagcctcccaaagtgctgggattacaggcatgagccaccgcgcctggccacaagtaactttttatatgaaatttccggtttcaattctgacatataaagaggtgggaagtcaccatttgtcctcacaacaagaataaagctgaacaaactgaaaaccaacaactcttcttatacggccagagaattgaggtcgctgccaccctgaaaactagaaagacaggcaaatgcacggagtcacagcttaccaggaacagaaactgctggagccagcacctgggaggagaacttaaatagtattgacagattactagaagctgagggtggcttggcttgagcattaaaaacgctctgagaaccagtcatggggggaatctcacactttcctaaatctgaccactagaaacccaacaaagttctcatggagaagatcagaaaaaatccccgaggattggcactgccaacttcagctacagtaaccaaaacagtatggagttggtgaaaaaatgtaaaacagactcatagatcaatggaaaagaaaacagagcccagaaatagacctacataaatataataaactgatctttgataaaggtgcaaagacaatttaacagagcaaggatggccttttcaacaaatggtgcgaaaacacctggacaaccacatgaaaaaataaataaatgtacatacagatcttataactttcacaagtggatcttataactacctgtaaggttcaaaaccacaggactcctaggagataacacaggagaaaagctaggtgaccttgggtttggtgatgatttcttagaaacagcattaaaagcgcaatccatggaagaaacaaaattgaaaagttgaacttcattacaattaaaaccttctgctctgtgaaagacactgttaagagaatgaaaaaacaagtcaagactgagagaaaatatttgcaaaatacagatctgatgaagggctggtgcccaaaataaatgaagaactcttcaaactcaataataagaaagtgaacaacccaatttaaaagtaggcaaaagatctgaacacctcactgaaaagatatacagataacaaataagtatatgaaagagacactcaaagtcatttgtcattagaaaattgcacatgaaaacaatgagataacagaacacacctattagagtggctaaaatctgtaaaaagtgacaatcccaaaagctgtcaaacaaacagagctacaggaactctcattcattgttggtggaaatgcaaaatggtacaatcactttggaaaattgtttgggagttttttttttcttttacaaagctaaacataatcttaccctataatcttgcaatggcagtttgacttatttagccaaatgagaggaaaacttatgttcacccaaaaacctgcacacaggtatttacagcagttttatttattattgtcaaaaactggaagcaaccaagacgcccttctcaacaagtgaatggataaacaaattgtggtgtatccatacaatggaatattagtcagtgatgaaaagaaatgagctatcaagctatgaaaagacataaagaaacattcaattcataatacctgaaagaagccagtctgaaaacctacatattgtatcattccaactgtaggacattctgagaaagtcaaaaagatagagatagtaaaatgatcagtggttgccaagggtgaaggagggaaaggagggatgaactagtgaggcacagggagttttcagcagtgaaactattacatgatactgtatttgggagtcatgacactgtaattttcaaaacccaaagaattgttttaaaaaaataagataaaagacaaaacacttaatgtgaactatagacttcagttgatgataattatcaatattggttcatccagtgtaacaaatgtaccacaatactgcaagatactaatgggggaaattgtgtattgaaggacagggaggcacatggaaactctctatagtagctgctcaatttatctgtaagcctagaactgttctataaagtaatatctattaatttttctaagttagaatgtgaaagctccaaattcaatttttggtggcatcctgatatcatgtggttaatacttggcattgagatgcaccaaactggagtcagagcagttgaagatttcaatgtctgtgccttcaccctctgtgcctggggatgcccctggaatccagatggcagatcagttaggtcgtagtggcatcagcactccagacagtgtaggttctagtaaggacagggtgaaatcaccttggagggcagaacttgctaaatacttggaaccacagatcaaaggagaaggagacagggaggaactgcaggctacagaatgagctccctgactgaaagataaaggcagcttcagagattttggcaaattttgtgagagaattaaatgtcagaaaaagaacttagatttcagtgcaaagtggtctatttaaaaagaaagagaaggaaggaaggaaaaggagggaaagagggagggagggaacttagatgaagactagaatatctgggaatgggcttaaaccatcaatcgtttccattaatgaccacatgctaactaattatagcacagagataccatactgtaacatcaagtacagttagcatgggggtaagaaagtgttccccaacctctccgttctcctctgaagacacattttcttctgaagaacagagatattgaatcttgcctttgggtaagtttgggcatccacatgaatgagctggggcacccaacaccagattacaccaggccacgaccttccctgctgccccttgcctgcttcagaggctgccccgctgcaggtgggggcctcagccccaggtctgatgttgtccatttgctttctcactgggcttctttccttgcactgacttccactccccaggactcagtgagtggccacatgggaaagacacaaactggccatgcccctttctctctgacacctcttgatgcctgcagaggtgagctccagacccactccatgagtagtgacttgagacttgctcacaatgatgtccctgtccaagagcagggactggcacttaatagccacacatgaaagctcagtgaaagaaggcatccaccacaaggtcctggaggaaaaagaattccactatggtccataacgttttagtcccaaaagatcccagattaggagatgtgaaaggcttttgaaagtggccattcttttaaagcattatgctggcagctgcactatgtttccccatcctggacatgtctggagggcactgtctacagccatacccacctccccacccaggacagtgcagcagctttaatttgggggatgccagtgggcaaggaaggggtgaaccatgaaagctgaacaggagaaagcaggtggaagaggggcaacagggtggaaatagagaaaataaaggtgggtagagaatggggggactcagggggagagagagagagagggagagagagatctagccactaaggaaggaaaaagtccagaagagaacacttgtctgcttcagtaaaataatttacacctaaccaggtgcaagggcactgcaggtcgtgggtggcatgccctggtcatgctgtgatgtttaggggccatgacatctaccctttgaatccaaatcatcaaatagagagggaactctgtccctatctagctggcaatgccttgcgattttaccttttagatctggcagctctccacatctgctcactttgtgggaggcagctcttgacgcaccaaatcaggatgattcaaaaatcagagccttggagacttcactggaaggcttggacagtgggaggtggtggcatccggagggtggagtccaagaggtagcagcgctgaggctccacacaccctcaggaggatggtaaggggcaatctcttggtgagcacctaacttccccaggaacctctgcctaggtggaaatgggccccacgcctagcttttctctggacaggccctagccagggatccagggtaccagttgagtcctaggcaatgcaaatgcctgtgtgctgaccttgtggtgactggaaggaagcaccatgatccttccacttggaactggacttgcaaagacgatggctcctactgctttcaatttccttggactttcgcaatcagatttagccttttggaatgtgaacatgactcttctgggtcaccccaggtatggggtggccttggatctgctggtcctccccaggcctcaaggactggctgatattcatcatctcggttggtgtcaccgcactcacaatccccagcaaagatcccccaaagtgtcctgactagaaacatattcctcaacttcctctcagctcgtggtagccattcttctgttagtgtaggctgcgtgtgggaggctggtggtgggtagggtgggagcctagagaaggaagaggaacggtagccaaaaaggagcagagaaggaggaggaggcaggaagtatagaaagctggagggagctggggaaaatgggtgtgggggtagtgtgaggaagacagggagcaggagagagaggggactggaaacagaaggagaggaggaggagaaagaggaggagaagaaggcagaataagaagagcagaaattccagcatatcccaaatcttgttccagaaatggttatcagtgccccatggataaagggaaaaggaaatttgcaaagaaaaagaaagaaaccccagcgggtagagggtctcggcagaatgtttatttcagagcaggaaactctggcaacccaggcagaactgttggctttagtggaggcctaaatatagctcttctctgttcctaatcctgaaaggtgcttaatctcattctctgagatagaaacctaaagagaagggcagagagaggtaagtctggggtgactcctcctattgtagattaaaggtactcaagtcctgtgtgacaaagagaaaaaaatacctgaaaaggaaattctggtgactatggaggctgagaattcacttgtcaaatgctcataactgagagtattctcaacagctggttccatgggttaatggtgagcaccctggactctgaatcaagcgatccgagttcaaatctcggtggtaccttggtgtctgctggccttttactctggagccagaagccactttgggaagcaaactccaccctcaaagacagagtgaaagggatgtggtttacatttgcccttcgtaccaagtcctgggttaaagaagagaaaggaaggtttgggtcccggggaaggaagctctgctgctgcaaatcccctagtccctcctgctccggcctcgcaatgcgtcccctgcaatgtccctcctcctctcccgtgtccctcctgctccggcctcgcaatgcgtcccctacgatgtccctcctcctctcccttttcctcctcagtggtctgggtcccagaaaccggcttcttgcagtggcctgctccacagggaaattgcccaaacatcccatcggagtcaccaatcctggtcccagtcctgggcgagcctcccggccccctgcaatcggaggcccggaccccgcagccagcgtcccagcaaccgaacaagtccccatcccctctcagggcgaccctgggcctcggggtgagaggtttcctacactaaaagggctgcggcccctcagtgctagaccccgagattcctttcactcgggaaatctcgtaatcgcatccattgtctttttggtaagtaaacggtgacgtgagaaattttgatggggttagctcagtcattggtgattatgtctcagtttagggtagatggtttgagacctaacttagaagtaacactgttttattcggatggcccatcctcttccgaatgttaatttactctgttcttcatattcagatttccatgcctaatttctagctcctacgtctctattgcgggacctaaaagtcgctgtttcactaagctttggaacccgactccaggaaatctcattctttcgtcccaaaatttcaaccgtaaagagaaatccgcgcggcggcctcttcaagcgcccgggccgggagcgcgggttctgaccttcggtcgccgggccggtctcccgcagcaccacgggtaagaggagcctgagcagctcggagggatgagtgcgggacggtgggggctccccctcttcctgccagtaccttgccccaaggagaagatgccttaggacgcgacagatgaaaaatcttttcttctgcttggcggaacactttggatgcggcttatggtgggtcttgagagcaagctaagatgtcccgccagacgctcaggaccatcgctctgattttcatattttgcaaatatgaaaattttcagcggttacgaaggactgaaaaacaccgcagtctttgaggggctcagtttggagggcgtgcggaggtgtggggtgggagacgggagagaggtgccttgttggctccttggagtggactgataggaaggaaaacacacaaattccatttccccttgcaggctggactgcagggcctaggatggaaaactgggcagtcaaagagcaacaatatgtagaggttgactgcatgcattgaaaattgttatccctcacacctgtaatcccgcattttgggaggccgaggcagtcggatcacgaggtcgggagatgatcatcttggccaacatggtgaaaccccgtctctactaaaatacaaaaattagccgggcgtcttggcgcgtgcctgtaatcccagctactcgggaggctgagacaaggcaatcgtttgaacctgggaggcggaggttgcagtgagctgaagctgagatggcgccactgcactccagcctggcgacagaacaagactccgtcgcaaaaaaaaaaagaaaagaaaagaaagaaggaaaaaaggaaggaaggaagaaggaaggaaggaagaaaacaaaattgttatccctagaaaaaagtgtaggggggaccagaacactgctgttgttgctgttcaccaccagctttagagcatatgtaactggtaactgtacagtgcatcaaaaatccttcctgtttacaaccaattatcacaactagctacagatttctttgttccttctccactcccactgcttcacttgactaaacttaaaggaaaaaaaattgtttttacatatgatattgtttaaattgatcctcagcccgtcctcctcaagtagctgggaccacaggtgtacaacacggtgcctagctaattttgtagagacaggggttttgccatgttggccaggctggtctcgaactcctggactcaagtgatctgcctgcctgggcctcccaaattgctgggattacgtgctggcctccatgcccagccatcatttgtattttgaatttaaatattttatagtcataagtatcactcttcaaagattctgagttttgtagcatgtatatggtgaggttcaggacacactactccaaaatataacaccttggggtattgaatattttatgctaaaggaatttgagaaaacaacaaaagcaggaaggtcactgtcaccctccccctgcccttcttccccaaagcagatcataaggctctcatgtgagaggtgctctctctgtacccagaggaaagatgcattgctgtgtctgaagacacagcgacacagagtctgagcacacaggcctggctacatttcccccagtttattaccattagatcatactcctttcatcatatctcacttctctatgactatccactagtcatcaaacataccgttaaaaaaaaacaacttgaagtttagctgtttcttcaggtcttcatttctttaggaaggctcttcttctatcatgtaaaacttacattaaataactagatatgctcttctcttgttagtctgtcttttgctataaggttctcagcagtgaacctaggctgggtgaggaagagtcatatttcctcccttacatgtacaaaatgtcttccactgtaaaactgtaaaaattttattgaggcaggtttgaagcaagaaattgaatcattattcccctttggatgaactgaacagatgagctaacaaacccccagttcctcccagatagaaatacttctctagctcattccctgaatctccttgagggtcaaacctgctggagattgaggggccttcctgggacctcccagcccaggagattactgctggtgagaagattgctgcagtttccctgggagggtgcacagccactggaaagtatcactgctgtaacttcaatacaacaaattgtcatcatatctgctcttttggtttatttatttttttggagatggagtctcactctatcacccgggctagactgcagtggcacaatcgcagctcactgcaacctctgcctcctgggttcaagtgattcttctgcctcagcctcccaagcaattgggattacaggtgcactgccatgccaggctaatttttgtatttttagtagagatggagtttctccatgagggccaggctagtctcgaactgctgtcctcaggtgctctgcccactcgacctcccaaagtgctgggattataggcatgagcccttgcacctggtcacatctgctctttgtgcagtgttgcaggcataatacaagagctaacatgcaaataagtaacatatgaacactcatcaactgtgcctgacatgccaagtgccacatgtcaggcacagacaatgagtgtgcataattacttatttagtctttaccacaggccaaggtcacaccatcatctttatcttccatatgagacaactgagatgcagagatgttaagttacctgcccagggtcactctggtcagatttctttcactgtcatactttttctatgtcaagtttttctcactgtcataattttttccagggcactttcattaggagcaatataaacacagtggttctgagaatgtcttctggagctaggctgccttcacttcaaattcttgctttcacatcctccttccctggctaagtgaccctgagcactgcatcttgcttccaacctccaagcttcccttgtccattcctggacataagccaggctaaatatgagaggagtttagttccaagtctaagtgtgaaacaaagatgatagccctttcccgagacaaacctcttcctttcttggggatcagacctccttagcaaagttaacaaattaggcacgagattggaaattatggctcaggagctatgaagccagaagccacaagattcctaagctccccaattgtgcctatagataacatcattagtgtcaaacctaagattggtgttcaaggtatttttcagaccctgccttatgatggactagctggcacacccagaccggtaaactggctcatctggtcctgtggcccccactcagggactgactcagtgcaggaagacaagctctgactccctgtgatttttatccccaacccaaccaatcagctttccccattccctagccccttgcctgccaaactatcctaaaaaaaaaaaaaaaaaaaaagtgtcctctgaatttggggggagacagatttgagtaataataaacctctgtcctggtcacttagctgtctctgcatttattagattctttctctattgcaggaagcctgcttttctcagctccattggcttttctgggcaaccagcaagataaactcaccagttacattaataaaagagaaacacaaatagtacatatgcttgaaaagaagtgtaagtctgtatatttcttttgaagaaacaggaaaggaggaggaataatatgacaggcaacacactgtcctaaatattttcatgattctcctgcctccccatatccttcttatcccaacaactgctccctagaaacctccaacttaaacacaatcctgccagaactaggtttgtccttctcttgcattttcctctcacttgccccacaccccttccaaatctgttctttcacttccaggtcattgagtttttccatttaaaaatatgaaagatacagaaagaagaagataaccagtcatccatattcccaccacctggaattaagtactgttcacatatgtacatatttttcttccaaatcattttaaagttactctcattttttttaaattatacatgcttagcataaaccataacactaatacagaaaaagtacagatatgtaaaatttctgatcaccataagttcaaaataacttttgttaacattagggcaacactgattgaatcatgttcttctggtatatctacagagagaagaatgtatattttagctagactgtccccccaacgcccctgcaaaagaaaaaacagaacaataaatatatatatatatatgagctatatattatatatatacatatatataggagctattatatagatacatatataggagctatctattatatatatacatatatataggagctaaatattatatatatacatatacatatatatatatacatatatatatatatatgtatatatatatatatgcttttctaatattgagcttagactctatttttattttacaaatattccatttgggtccggcgcggtggctcacgcatgtaatcccagcacttcgggaagccaaggcgggtggatcacgaggtcaggagatcgagaccatcctgggtaacacagtgaaacctcatctctactaaaaatacaaaaaattagccgggcgcggtggcgtgcgcctgttgttccagctactcagaaggctgaggcgagagaatggcgtgaacccgggaggcggagcttgcagtaagccgagatggcgccgctgcactccagcctgggcaacagagcgagactccgtctcaaaaaaaaaaaaaaaaaaaaaaacaaaagcaaaaacgaaaaaacaaaaaacaaaaacgaaaaaacaaaaaacaaaaaacaaaaaacaaatattccatttaatggtgcatgaatttaactgaagacaaagagacagaaacagaaacgaaggaattcctgaactctcaatcacatttagagagacgcttttctaaaggaatcctctaaagctaaacataagttaaattaagtagaatgcattatgatttgcagtgtttgtttgtttgtttttgagatggagttcttgttttgttttgttttgtttttctctgttgcccaggctggagtgcagtggctcgatctcagctcactgcaacctccgcctcccaggttcaagcaattctcctgcctcagcctcccaagtagctgggattacaggcgtgtgccaccatacccagctaatttttgtatttttagtagagatggggtttcactatgttggccaggatggactcgatctcttgaccttgtgatctgcctgcctcagcctcccaaagtgctaggattacaggcatgaagcactgtgcccggcctttttctttttcttttgttttctttttctttttctttttttttttttttagagcagcatcacttgctctgtcacccaggctggagtgtagtggcgcgatctccacatgctacaacctccactcccaggttcaagagattctcctgcctcagcctcctgagtagctgggattacaggcgtctacatcacacccagctaattttttttgtatttttagtagagatggggtttctccatgttggccaggctggtttcaaactcctgacctcaggtgatccgcctgcctcagcctcccaaagtgcaaggattacaggcgtgagccaccacgtctggcctgcagtggttttcttactactttttacaatcaaattgattaaggcattggttgaatatggtacaatacatccatttcaagtttgatgacatgtctactactccagaaggtcctcttgtgccctttgcagtcagtcccctcgactccctgaccccagcaattaatgatgtattttctgccactatacaggttagtttcacctgttccagaaattcaccttgatggcaccacacagaatgcactcttttgagattcacccatgttatctcatgtttccataatttgtcccatcttactgagggtggtattccattggatgaatatatcacaaaaggtccattcacctcttgatacatatgaactgtttccagtttggggactattgtaaacaaagctgctaagaacaagttctttttgttaatatttgttttgtaaattccgtttgtcattctttagtattaacttattttgtaaaaggacgtaatcttcataagtgcaaaattcattcaaattttacagaggcctgaagcagaagcctacacaatttcctttgttatatttcataattaaggggaaaaaaactttatctgggatgttgtttcctatcagcaaatccttaatgtaagccatacaggatgctagctgtactattagactatcttctgtaatctgtgcaataactctaagaagtacttcgtcttattattttcctgtaacactttccaacttgaagcctagcaaattgaaggacctggccccaggtcaaacagaaggcaagcggcagcgccagtactggaagaaggccttcccaaaggcagacagaagctcacgtctttgtcagaacctcggtatttctgatgcgcctggaagccaatatccaagccgttctcagccactggattggtgggctgctttgctcagaaactcctcgatcaggaatcccaagcatacgttagtgatgacggtcccaaaacaagggacatttcttaaccattctaaaaacccgtttgctcattagtaacgcaatgaaagttgctttcgtcttggttcatatattttatatttgagcaaggcaatgtccgctgctggggttagaagtaaatggctcgtcttcatcaaactagatcagtccgtaggacgtatggcttccactcgcagtgtcctgaacactggctgggcttcctgtgcgttctagccggttttctttggagccgcgggtttctgcaccgcaccctagtcgggatggcagaggcttctcggaacacgcggatctatgagtgcagtccccggggtagccaccagggaacgccataggctttcccgctgtgttcctccttgccttttccgtttgggccaggtagtttctattgaccaggacattacagatcagaagtgggtggggtcagaaaacacaccctgggagaggctggcaaaatgcccagaaccgccatcactaggactggggttttcttctgtagtggaattctcgtgttcatgtagtgcagggaggatcgcagcgcatttccgccaagacaagtgagactgcggttctgacctgcgggcctcgatgaattgcgttaggacacctgggcgctggcagagccgttctcctacacaaagcaagcgtgttatgtctacaaccgaacggggacactaagagccccaaaggccctgctttcatcccaaagaagagtgcctgtctgcgtagtttccacctggctctatgaggtgagaactgattcctcgctagcacagaaatcctgaaacagaggctgtgtaaaaggtgacaggggcctaggggaaaacacgaagattttcacagagcgtgagaccccaagagactggagaccatggatcaatttttgcaataagcagccttatgttcaaagggaaaagctatgcagccttcgcgctagttaacttgtgataaacaggctcacaacggctgacgcttgttccttctccagcgaggacaacgacatgccacttctgttccccagccatccaactgtaaaaataacatgacaccacccatattatgcactactaaaagtatcccttcacatacaatctgcgttttccagcacaaaattcagaggacagcgcgaacgcagtcccccactaccacaaattatgcagtcgagtttcccacatttggggaaacggcaggggtcagcacatccggagtgcaatggataagcctctccctgggaaaaccaccttcgtgatcatcgtatctcccctgccaggtaagtatgagatcatacgcctccgccctgccacagctccatacgcctcaccccttacacgcacggtcacttcccacgcgcaaccccccaccgccccccacccccacccccagccctcctagccctgacacacagctgggactatcacgtccaaccggcggtcctggacttgctcccacagcaggagaaatcctccgtggcgaagcagcagcccctgagatgcctcatctacacaggaatcgccctatccgtgatgtcaccgacagcacctttcccggtccggctctgctcttctgccccaccctctgccacctcagccgatgaacccgctgcgggagccggcggaggaagtgacgcctgcctctccctcttttccctcccatccacgcccctggtctctcccagagaagtaggttcttagtctgtgatgccaaggacccctttggcggccagctggagcctgtgcgctcttcttcaaataatgtcttttaatgcgcaaactagaaagttcaggattacaaagaaaactggttcttttcacatacggttatccttgtgatgtagcattccgcttgacattggaagtcgttcgatatcagagagaaaccatatctacgaaactagagaggctgctcagatgactacaaaccagccattcttacttgttttatcactgggagtgttataaagatggtcgtccagtttcatgattcttgcagggttttttcaaatacagcaatgtacaaaaatgtgctgctccagcagagcacactggacacgcagacatggtgccggagtttgccatctcttccactgccttctctagaccttggcgcttacctcatgttaacagtttatatgctgcaaagacagaaacaaagtcatccaaatttggcaaaaatatttgggggaaattttatttcaggtgtttaactgattacttttaatatgtagactacaacaccaaactctgacaatactccacagacttattaatggtttccacccccctctctgcaaatctatcaggcaagtttttcctgcccttcactttcatataagctgagtcatacagtgtgtagtgggttttgtggggagtgttactgcccaacatgttcaccttgcctgctgcctagacagagccaatttttcgacacaggggaattgcaataaagacctgcactttttatttggtggttgggggccagtgagttgagagttgtgattggtcaggtcggagatgaagtcacagggagctgaagctgtggtcttctgctgggtcagttcctgcgtgggggccacaagaccagatgagccaggttatcagtctagctggtgccagctgatccactgagtgcagggtcggcaaaatatctcaagcactgatcttaggttttccaataacgatgtgatctccaggaacaatttggggaggtttagaatcttgcagccagaggctacatgactcctaaaccataatttctaatctcagggctactttgttagtcctgcaaaggcagtctagtccccaggcaggaagggggtttgctttgggaaaatgatattatcatctttgtttcacagctaaaccataaactaatttcctcccaaagttatttcggcctgtgcccagcaatcaacaaggacagcttggacgttagaaacaagatggaatcagttaggtcagatctctttcactgtgataattgtcccagttgtaacttttgcaaaggcggtttcagaagcagaggcataggtttgacttctttcactcagtcttatgtctatgaatttttcatgttattcatatggttatttgtttctatgtgtattcctttgtaggaatatacactaacttatttatttcttctgctattgttgagcatgttgacctaaaagaaagaggctgaagcacaaaatataatttagagtttacctgagccaacatgaagagagctgcctggaagactcacactcaaggaaccttggatctgagctccctttgatctttgtcacaagcaggtatttaaaggtcaaaagcagggacagacagtgggctgacagaaaggtgcctgtcaggagttctcattggtttacagaaataacattgattggtgattggctatatgttgttaagttatagggtatgggggtacagggattggtgtggcattattaggttaatttacagctacttgaggcaatagcaagcagtttcaacagatgaatacatagctcagtgcagctcaaaaggaaggagcagaaagtggttgctgtctcgatttaacctctctctgggcctgatcatctgagagggctcacattcctcagataaaacatttttaaaaaactttcttcttgaaagcattgatgatcaaaagctcattcaaggtgtccctctttgccagaaaggcttattcctggatagtcctgtcccaggcaggggacaggggaggaaagaagccacctcactgaggaatttttaagaatgcccaaaagtccaattgaaagggcattacaaccaggcacggtggctcacatctgtaatcccagcacttcaggaggccaagatgggtggattgcttgagtccaggagttcgagaccagcctaggcaacatggcaaaaccccatctctacaaaaaacacaaaaaatagccaggtgtagtggcacacaccttagtcccagctactcaggaggctgatgtaggaggattgcttgagcctgggagttcaaggctgcactgagctaagatcacaccactgcactccagcccaggtgacagagtgagactcggtctcaaaaaaaaaaaaaaaaaaaaaaagagagacagagaggcctcagttaagtctgcagcttctgtcacttgttgaatcatctctagtcttcagaataccatgaaattagttttctcagaagtaaaacgatgagaaatacataacaataatgacattgcacttcatcattccatttcctaagacatttatagggccatggatggtgatcttttcaagagacaaaaataaacgcgggtgcagaacaggtaagtgcactataatttgagtacatcagcttttgggcattaaaatcgtgggtcagaaatttagagcaagagggcaggctggatcctgatagcaggagagtgtgtgtgtgtgtgtgtgtgtgtgtgtgtgtgttttgagacggaatctcactctgtcgcccatgctggagtgcagtggcacaatctcggctcactgcaagctccgcctcccaggttgacgccacactgagattccctagtagctgggactacaggcgcctgccaccatgcccggctaattttttgtatttttagtagagacggggtttcaccgtgttagccagggtggtcgcgatctcctgaccttgtgatctgcccgcctctgcctcccaaagtgctgggattacaggcttgagccaccgcgactgtccgagtgtttttcttttaactttccagtagcatcatggtgtttaccactgttatttcagagtgaagtgacaattttgttgtttggttggttttgtactttttatttttattataattactttttaagtcaaggactctgtctcccaggctggagtgcagtggcaaggtcacagctcagtgcagccttgacctctagacctccaaggctcaatggctcagcctcccaagcagctgggactacaggcacacatcaccacacccagcttatttattttttgagacagggtctcactctgttatccaggctggagtgcagtgacatcatcagggttcactgcaggctcgaactcctgagctcaagtcatcctcttacctcatgctcctgagtagctggactacaggtggacaccaccacacccagctaatttgtatatattttacaaagtcagtgtttcaccattttgcccaggctagtctcaaactcctgggctcaagtaaccctcctgccttggcctcccaaagtgctgggattacaggcagttattttgacaatacgattatgatggttaaactgagacgtgtgccaggaaggttagggtgaatcagacagattagataaacaggttttgcttgatatgaccctgagttgcatcgtgagtgcaatcaggaggaatacaggtgaaatttagcacaggatgtaccaatgggtcattacggtcaaaagtggtttgtggttctgagtggcaaacctggaaccttgtcaaatttcccacagaggtaatggtttgtgagattctgatcagagaattatccctccctgctgtaatcaaattagttagggacagtaaaacagaaatctgatcataagtattttgctatgtatgtatgtatatgtatatacacatacacacaataggactagtgtggcatatcttaagagaatatgcatatagggtgattttaccaaaaccaccaagagacaacccctacaacttaaaggagccctaatggtgtgtgtattccagtcaacaaaaaagagactaactctttcaggtgcagtgagcactggaattgtaactgattatacaggccagtatcttgggtgaaagcggactaccacagatgtcagctacttgccatctctgtcaggaagattgagttacctttaagtgaaaatctcctgacagatgttcactctggcagggttgccttttacaagagaaacatgaatccgtgtgtcaacgcacgtaagtttaatggcacagattggtcagtaatacctgttgtgagtcaggtgcagtggcccatgcctgtggtcccaactatttggaaggttgaagcagaaggatggcttgaacccaggagttcaaggctacattgagtcatgattgtgccactgcattctggcttggggaatagaatgggatcccatctcaaaaaaatgtataaaataataataatacctgatgtggtcccttccaacagtcttggggggaatattttatttggtgttgtttctagtaaacaacatctccaggttataggccgtgatttttagtattttcatctcccaggagtgcattatgaaaggaatcctttattaatgtggagttcttagtaagttttgagagatcttagcagtaatggagaaagtcacctttaagaagtgcagattcataagcgccttcatctaaccactgcatgggtcttccgttattatttcaaagagagggagtgtggacattttccagaaccagtgggagatccttggccaagaaaggttaaaaacttctgttagctttgccaactgagtttttattgtgtcattagtacattccatcggcccagaggattatgggtgacaggcacaatggaaatgttgggacataggcaaaacattacaaatggatccaattacctgaccaatgaagtgtgttcctcagttgctatggcattcagatggcactccccatgaggaattaccttttcttttctttttttttttttttttttgagatggagactagctctattggaaggctggagtgcagtggcacgatctcagctcactgcaacttccgcctcccagattcaagcaattctcctgcctcagcctcctgagtagctgggactacaggtgtgcaccaccacgcctggctaatttttgtatttttagtagagacggggtttcaccatgttggccaggatggtctcgatctcttgacctcgtgatctgcccaccttggcctcccaaagtgctgggattacaggggtgagccactacgcccagccaggaattaccttttctaatcacaatctacctactacttgggctgtggctcattggcatggaaatgctcaccccagtgagcacgtacaaattaacaccagaaagtatctgtgaccctgagatggagacagctggataaagtctaactgccatgtctcgaagggtcctaaagttaaaatgtccttgtgacccatgaaggggctttccagggtgatgtttgggacaaacagtaccacaagaataaaccttttctgcaatcataggcaatgattttcaataccattgctttccccatgctaacattttatctgatttccaatgaggcagcttatgaagtactgtattcagggtaattgaagcctaaggggtggatcagtgtatcattgggcccataccataagcctgtttctggaagaaacttgttccctttatccttccagagatccctctcctgcttaggagctcccacttacgcttctttttttttttgctagagtctagctgtgttacccaggctggagtgcagtggtgcaatcttggctcactgcaaactctgcctcccaggttcaagcaattctcgtgcctctgcctctcaagtagcaggaattgtaggcatgtgtcaccacaccagctaatttttgtatttttagtagaaacagggtttcatcatgttggccaggctggtctcaaactcctcacctcaagtgatccaccagcctgggccgcccaaagtgctgggattacaggcatgagccaccatgtccagcccacttttacttctaatgaagtcttcaatgggtcataagtcagcaaggtcatttcgagaagttctgtgtctgatgccaccttcagaactgcattcttagctgcagcatcagcaaaatgattgtccttgctctccggaatatctagttttgaatgaccaggaattttgatgatggccaaagataagggttttcaaattgcttctaagagatcagagatttattggtcatttttgatggcttgacctgatgaaatcagatacctatgttgcttctaaagcattccaaaatcatcacctactccaaatgcatctctgctcccagtgtaaatgttaggctgaggtggaaggattgattgagcccaggagttcattcaggtccagcctggaaaacacagcaagatgtcctctctacaaaaaaaaaaaaaaaaaaatcaaagaattagctgggcattgtggcatgcacctgtggtcccagctactcgggaggctgaggtgggaggattgctagagctgagaggttgaggatgtggtgggccatgatggagccactgcattccagcctgggtgacagagtgagaccctgtctcaataaatcaataaataaatcttaaccatttaaaatatcaatgacagatttgtttggccttttaagtgcattgctgaattctccaatctacatattggggaacaacctgggtaatggcaacatggaggtatttggcaaaaatgcagaccctttcattgtctgcttctgtctgtttttaaaaaccctctaaaggattattccaattcaccctttccaaccatttagtggccctgccttcttacaccaacatgtgaattaattgataaagatcagaatatccaggctcaaaagtttggacaattaagtcaaattttctcctaaaccctataggatcttggaggttgcttttgaattagaaagggaaaattcagctgggtgcagtggctcacgcctgtcatcccagcactttgggaggccaaggcgggtggatcacaaggtcaggagttcaagaccagtctggccaagatggtgaaaccccctctctactaaaaatacaaaaaaattagccaggcatggtggtgggcacctgtaatcccagccacttgggaggctgaggcagagaattgcttgaacccgggaggcggaggttgcactgagcagagaaaaaaaaaaagaaagaaagaaagaaggggaaaattcatgtaaattttcatcagggaagtcttttttttttttttttttttttttgatacagagtcttgctgtgtcacccaggctgagtgcaatggcatagtcttggctcactgcaacctccacttcccaagttcaagagattctcctgcctcagcctcccgagtagctgggattgcagtcatgtgccaccatgactggctaatttttgtatttttagtatagatggggtttcaccatgttgtccaggctgctctcaaactcctgacctcatgatctgcctgcctagtcctcccaatgtgctgggattacacgcaagagccactgcgcccagcccagggaagtctttttataatattcttaattcacattttggtgaagcagtatacagaatggtaggctcccctcttcctgtgggttttaccttgaaaggggctgtcagaacagaagtttcagggaaggggccagagccctggggactttcctcaggtgatggtgatggaagaagaggcaaggcaggaccagagggctcaggtaagggagactatgcaggtgcaggggcaggaggagaagcagcagttggaggcgaaagagacaaagcctcctcaatatttctcaattcagaaaacgtgtcagatgacttccttcagcttacttcctcactggaggcaattttctcagttcttttagaaatttctaggtatcattggaagtatgtctcccatttaatttggttctaaaaccaaattttttggccaggcgcggtggctcatgcctgtaattccagcactttgggaggctgaggtgggtggatcacgaggtcatgagatggagaccatcttggccaacatggtgaaaccctgcctctactaaaaatacaaaaattagctgggcatgctggcgtgtccctttagtcccagctgtttgggaggctgaggcaggagaatcgcttgaacctgggaggcggaggttgcagtgagccgagatcatgccgctgccttccagcctgggtgacacagcaagactccatcaaaaaaacaaaaaacaaaaaaacaaaaacaaaaattttccaattgtgcacactaataaattattttaagcatttcaaaagatcccaattttcttcattctgcttatgacttaggaaatgaccaggaaatggttaggtgggtccagtttcttggatatttacaagaggatgcttcataagtgttatacataaacccagctggtgtttctaaaggtggttgtttcttcacagtgtgctgaattttgaagcttgatttcccataattcaggagcttttcagatgaccaaggcctgcgatgtgttttgggtcacagtgtggtgcttatgaagtcactcctacagataacaccggagttgtgtgtcactgtctcagtggttccactgtttctaaccaccaggtggccacagagtcccacatatatcctcccagaagagcaggaaagggggttgataaaagtgttcttctgatgggaagtgtcctataaggccaccttcacatggtgactaatgaccccaacacctctgcaacatccccgatcacttggagcacctgaatggatcagcgggagcagatcacttcttttcttcagggcaggggaacacacctccatgcactttccagttaagaactaacaggaattagtcacaaatgaaaacctaagtccaaatgttcaaaacaacatgctacataaaacaaaaccaccagggcctacctgccaataccttgacccagaacttcctgctgaggaatagaggcagaaaaggcagaagctctctggggagctctttgcctgactgtgacccaaaccttctgtcctgatgcagaggtggaaaaggcagttatttccccctgaaacacaaatctcttacccacagggtaaagacagaaaacctctgttctagaaagggagagctgaaaaggacactcaagcaaactccaagacttcaatcaaccagtgtttctctcagagtcagtactcgaaggcttcagagctggccaggcacccagtccaggaggaatgtggtgtgatctgagagatgaaaatacatgcccccttatagactaagacagactgtaaggttaaggaaacaaaagttagctacttgtccagggttcagggctcatctggcatggcaacttcctgaattcctatggctacaggaaaaaccacactcttgctaaactccttaacaataggagctagcaagcaaattgtcaaaatcttcccagcccttctcaactggatttacaagccagatcactagagctctgatgggacagaggagtggccttccattctttcctaataagcaactgcagatatcaagccagtttcagccatgttacagggactgcacacaaaccaacttcatgtccagtagttcaccttttgatataaagagccaatttctgccttattttatgctaaaatcccttccccatctgtgaagatggggtgcatgttacatatatgtttacccattgcacatgagctcaatactcctcagaaatggtgtttccccaaacctactgaatatgtatgactctattgtgtgatacacaccctgtgaggcacaaaaaccaacctgccctctctctctgtctctgaagagaaagtgcctcttcaaagacacacaccggagactgtcacttcctggactgcaaacttatatcaccaataaaattcttactactatttagccaccctggaggcctttgagaggacagtcagatggtcagagatgagtcagtctgaatcctgctcccagggccaaaaacattgacatagaaggaaggcgcttaagcacaaaatatgatttaaagagtttgtttgagccaatgtgaatgtagttgcccggaaggctcagacccaaacaatattggatatcggttctatttggcctttgttacaagcaggtttgtaaagaccaaaaagggagtcagggagttggctggtaaaaagttgcttgtcaggaactcccagtggtttacagaaataacattgattagctatacattgttcagctacagggagtgagagatggtgtccagagcagcatgtttaggttactttatagctaactgtggcaatagcaagcagtttcagtggatgcatacatagctcaaaagtggggaagtggccggtggtggtggctcatgcctgtaattccaacactttgggaggccgaggttggcggatcacctgaggttaggagtttgagaccagcctggccaacatgaggaaatcccatctctactaaaaaaaaaaaaggcaggcgtggtggttcgcgacgttagtcccagcaactcgggaggctgtggcaggagaattgcttgaacctggctggaggaggttgcagtgggccaagatcctgccactgaactccaacctgggcaacagagtgagactccatctcaatacaataaaaaaaatattttttaacttaaaaaaatttagaaagcaggaagtaggatgtggttgctctctcattttaatgcctagctttaggcatgctaaattgaaagcactcattttcctcacatgaaaaattcttttcttttctttctttcttttttttttttttttttttggagacacactctcactgtgccacccatgctaaagtgaagtggcatgatctctgctcactgcaacctccacctccagggatcaagcaattctcatgcctcagcctcccgagtagctgggattacaggcgctaggcaccatgcctggctaatttttgaattttagtagagatggggtttcaccatgttggccaggctggtctcgaactcctgacctcagatgatccacccgcctcagcatcacaaagtgctaggattacaggtgtgagccaccatgcccagccaagaccattaatttaatctatagctaaatctattcgtttttcatgttacaaattcaacaagaaaaattttccctaatgaaacatcacatttaaagctaagtagaaaaaaaatgtaatagtgccttgctgtgtcatccaggtgagagtgcactgatgtaaccacagctgaccagcctagaactctgggctcaggcagtcctcccagctcagcccgccttctaattttttagagacggcatcttgccctgttgcccaggctggtctccaactccttgcctaaagcattcctcccacctcagcctcctgattttctgggattacaggtgtgagtcaaccagcctggcattgcaggaaaaaaaaagcccataaattattctttattttattttattttgagttgaggtcttactctgtcacccaggctggagtgtggtgttacaatcatagttcactgcagcctggatctcctgggctcaagcgatcctcctgcctcagcctcccaagcagctgagactacagacatgagccactgtgctggctagtttttttaaattagttcattttttaaaatttgtagagacaggggtctcaccatgtttcccaggctggtatcaaactcctggcttcaatccttcttctctcctcagctgcctaaaatgctaagattacaggtgtgagccaccacaccctgcttaatttccatattttaattttatatatgtaattattactgtctttaagataattggggcagtaatctctttaaagctttagggacttaatttatctattcactccactggaagagtatgacaattggtttcataagaaaaaaatttataaattagaaaatttctttccaccaatctagggggcattcaaaagcaaataattgcgttaagtaacatcatttaaggtgaaaacagatgcagtggtatctattaatgcttatcagtaagggaaacaaactgaaaaaatgaacatcattagatccttggaaaaccctcattgctgaaaatctgagtgattctgggatacccttttgagtctggcagggcattctctttccggagcatataaaagtgagtaaatcattttttttaatccattttcattaagagctgaacttccttaattttctggagattattaaatttgatttgtggccaggagcagtggcttacgcatgtaatcctagcactttgggaggccaaggtgggcagatcacttgagttcaggagttcaaggccagcctggccaacgtggcgaaaccccatctctactaaaaatacaaaaattagccaggcatggtgttgcatccctgtaatcccagctactcaggaggctgatgcacaagaatcgcttgaacccgggaggccaaggctgcagtgagccaagatcgtgccactgcactccagccttggtgacagagcatgactctgtcttaagcaaaaaaaattttgatttgtagagtttagagaagtgcttatgttgctgactccattgcttatttgtgatcatataaatctcttttctcctttctgtagtgtgatttaaacgtaatccttaaaggacatatatttcagctggttagagttttttagctggtagaaaactgagtgtatgaatcaaagaaaactgctcctttcatgctacagacttagttttatttctgtactaagatttcttttaggtatagtaatctgttaaagccaagagctcctatggaatgaagttcagtggcgggttacggggggcattgagtagtaagatcatctttataatagagatgccactcttgcaaatattgacagctattgagcccaaaaaattgttaccaaacattggaaagacaagatatgagcaacttctcattgctgcagtctcaaatatcaggaaataccattatcctcaggacaatgaacagaccatcaaaagagactcacagaccagatcagctctcatatatcaccaaacagggactggatccttgtcaaacaccacctaacagagattgtccccagaaattcacttcataacatcaaaaccagaaacccacactgatgccactgatggcagaaaacagtgatggaagaaagagagagagggagatagagaaaggaaggacttgctcaatgaccatacttagtatataaaaagcaaaacagctcaacttctgctcatgaaaacaagaaccaagggaacaagagccaatatctctaaggatccaggtctgcaccaggggcctgttaggtgcaggattctgttggctccaatgatgggtgtcagatggattaatttttatggacatagcctctgaaagaaatccgtcgaggctaataatacggagacacttgtctgcatgctcattctccattaatatagaaggaaactggcattagattgttttcatcaaataaaagtaaaatcaagatttataaagagaagaggaaaggggaggagaaaaaaaatgactgggaccattgtgattttgctccctttggataagcaacttggcagaaagctatcaaagaggtcactgtgacctgtcttctctggaccaatgtgacttggtcatcacaggaaacaattacaggctgggcacagtggctcatgcctgtaatatcaacactttgggaggctgaggtgggtggatctcttgagctcacaagttggagagcagcctgggcaacatgatgaaactctgtctgtacaaaaaatacaaaatttagccaggcatggtggtgtatgctagtagtcccagctactcaggagtctgaggtgggaggatcacctgagcctggggaggttgaagctgctgtgaaccatgattaaaccactgcactccagcctggatgacggagtaaaaccatgtctctaaataaataaattaaatttgaaaaagaaacagggccaggcatggtggctcacacatataatcccagcactctgggaggccaagatgagagtatcacttgagctcaggagttcaataccagcctaggcaacatagtgagaactcatctctaaaaaatacatatttcttaataaatatatacaataaaatatataccatattttattatacataatatataattgtatgtatttattatcttaataatatgtatatatttattaaatatataaaataaaaaagaaacaattacagacgttggaggactttaaaatatctcagccaggtgcagtggttcaggctggtaatcccagcactttgggagactgaggcaggaggatcacttgagcccaggaggctgaggctacagtgaactatgatcgtgccattgcactgcaacctgggcaacagaacaagaccctatctcaaaaaataaaataaaatgtcttagaagtttagctgtccatcctatgcaactgaatatctgtgtgtaatgtccaccatgtccttctgtttaacctcccccttacttaagccagaaaggcatttgtccccttattagaatatcattggcacatggctgggggtggtggctcatgactgtaataccagcatgttgggaggctggtcaggagtttgagaccagcctggccaacatgatgaaaccttgtctctactaaaattacaaaaattagccgggcgtggtggtgcaggcttgtaagctgagatcacgccactgcactccagcctgggtgacagagcaagactttgtctcaaaaaaaaaaaggggggggggaagaaaagaatatcatgggcacatgtatagaaagtttgttaggctgggcgcagtggttcacacctgaaatcccagcactttgggaggacgaggcagatgaatctcttcagcccagaagttggagttcctggggccaacctgggcaacatatcaagatcctatctctaaaaataaaaaaaaaaagttggatttgatggtgcacacctgtagttccagctcttctggaggatcactagtgccatggttgcaggggcggtgagtttgcagtgacatgagatcatgccactgcactccatcttgggtgatagagtgacacctagtctcaaaacaaaaagtacgggaggggagaaaatttgttgtgtcagcaagtaaatgaagaaagggacattattagagttgagaaataaactggaatgtgatttggtacctctcccgcagaagataagtttgctaaatgtgctgaaattagaagcattgtataaggccctgtgcagtggctcatgcctgtaatcctagcactttgggagacctcggaggtgcccgagcccaggagtttggggaccagcatgggcaacataatgaaaccctttctctacaaaaaatacaaaagttagctaggccttttggatgcgacaactgattgtgccacagagacacaaccctagtggcttaggactctgggaagatataatctccgccgtttatctagtgattgataatgcatgaacgctttaaaagctgaagcaggcagccgggcagggcgcggttgcttacacctgtaatcccagcactttgggaggccaaggcgggtggatcacgaggtcagctgatcgagaccatcctggccaataaggtgaaacctctgtctctactaaaatacaaaacattagccgggcggggtggcgctcgcctgtattctcagctactcgggaggctgaggcaggggaatcgcttgaaccagggaggcggatgttgcagtgagccgagatcgcgccactgcactccagcctggcgacagagcaagactctgtctcagaaaaaaaaaaaaaaaaatctggaggaggcatccctcagtgggctctaaccaccaacctctagattaacagccgaacaagctaaccgattgtgccacagagacaggtattgtaccttcttctgggcactataggaagggtgcactcaccaaacactcccccaaccgtcccaacctcagagcccaccagacagtacaactgtgcaaggctttggaaaactgaagagattagagtggtgaatcgtgttagtctcattggagatccgcaggttgggagattctggaaccaggacgaccttgcccctcgccttcatcaaaagctgccggaaacgccccggccccgacacatacctgaaccgcctgggggcccaagggaaactgaaaggccggtgggctcccgggatggctcttcccgttctttgcgcctccttcacccagtgagggagcctgtgcccactctgcccagtcacttttgaggccgctgaggaacttccgctgccatcttcggatcctgtgtcccgcacgggggctccaccagggcagggatcgtggtgagggtggctcatgggtcccctcgcggggagcagggtctggcactcaccagggcgcacgactaggacttgttgaattaatccatcctcgcctttagcttttaggcctttgaagagccctgaaaatggaaatcatgaaatattttaccatggggaacttttgatttgctttttgttgtttgtttgtttgttttgtttgtttttgagacagggtctcgcttggtcgcccaggctggagtgcagtggtgcaaacacggctcactgcagcctcgacctcccggggccgtcgtcgcctttagcttttagtcccttgaagaaccccaagaatagaaatcatgagatttttccatggggaagttcttttttcaaagcgtctattcacgttgatttctaggcatcccccagggagggcaacgggcagggcctccagtgcaccttctgcgcggtggagccgcgggggctcagttgggcagtagtagggatcgtggggagggagggcaggagcgggggaagagaaaagcaaaagcaaggaaagaagccggggagcggtggaacacacatccggacctcctgaaaggctggtgcagaggcacaggctggatctggaggtgagaattgttttgttgttgttgttgttgttgttgttgttgttgttgttgttgaagcagaatggggaggaactgaggggaaaattcagagacaacatagaagagcttcaaacgcgaggacctataactccccaagaataacatcttccagggacactagacagaaaactaggcatctgggaaccctgaaatccctggaggagtagcatcatcatgaccctctgtgttccttttggcaaaaggacttgcttcccttgtttgtacaattgtttgtgtttgttaaataaataaaacccttttcatatatctttgaaagtatattggctctattattttatgattacaaataatgctgcagtcatcattcttgtacacttctcattggccactggtgtgtttctacagggtagaggcttggagagcagttgctccagcatagtgtttacatattttttatatcattccattttctttccttttttggcttattagctgtaactctttttttcttcttgtccaccgctccccgacttcttttcctgcttttgctttttcagtgatggctttagggttttcagaatacatctttatcagtgccgtctagtgacattctacctccccttctggctgttatgttagtgttgttatgtaatttgattttagacatgttataaaccccagaatccattattatttcttttgtttaattggtcaaattattttaaaagatttaaataataagaacatatatatttaactatgtacataccaattgccactagtctccatttctttttgtagatccagatttctgtatggtatccttatccttaggcctggaggaatccttttgcatttcttgtagtgtgggttgctgaattctttttttttgttttgttttgagatggagtctcaccctgtcacccagattggagtgcaatggtgcaatctcggctcactgcaacctctacctcccgatttcaagtgattctcctgcctcagcctcctgagtagctggaattacagacacaccccaccacacccggccaatttttgtatctctggtagagacggggttgcaccatgttggccaggctgggttggccaggctggtctcgaactgctgacctcatgatccgcctgcctcagcctcccacagtgctgggattacaggcatgagccactgcgcccagctagaattctttcattttttttctatgtatttaaatgtcctcattttagtcacattcttgaaagaattttcattttggcatagaattctaggaaaactttatttctttcaacactttaggatgttgccactttgtttttgcaaaactggcataaagtgggcttcttgtacttgttatataatttttggaatgtgtatttaaattaataacataaaatggggtggactgctgggcgcagtgcatcacgcctgtaatcccagcactttgggaggccaaggtgggtggatcacgaggccaggagattgagaccatcctgctaacacagtgaaacccagtctctactaaaaatacaaaaaacttagccgggcgtggtggctggcgcctatagtcccagctactccggaggctgaggcaggagaatggcgtgaacccgggaggcggagcttgcagtgagtggagattgcaccactgcactccagcctgggcgacagagcaagactctgtctcaaaaaaaaaaaaaaaaaaaaaacggctggaagaggtggtgcacgcctatagtcccagtactttgagagggggaggcaggaggatcgcttgaggctcagagttggagaccagtgtgggcaagatagcaagaccctgttctctgtctcatgtatatatatatatatacacacatatacacatacacacacacacacacacacacatacataaatcgtgaatgtcctagattcatcttaagttccaccaacagtacacttaaagtaaaatgtgcccaacctgagggtcaaacctacctgctgacgtgcagtttgtgtttgtgagacattctcaacagcatttgctttccctagcatagtggttttcatgttttcctcacacctgaatgtcttaagtgcaaaacttgtcagaaataatttcctttgccaaaagattctaaaatactttttttttttgagatcagctcactgcaacttccacttcccacgttcacaggattctcctgcctcagcctcatgagtagctgggactgcaggcctgtgccaacacacccagctaatttttgtatttttagtagagatggaattacatcatgttggccaggctggtctcaaactctgtacctcaagtagtgtgcccacctcagcctcccaaagtgttgggattacaggcgtgagccaccatacctggcctaaaatactcttacttcaagtaaaagtgcattaaaaacaaacttctcatttgcatccctggaatctatagaaagcccggggagacaatcaagtgctacaggatcaagcgctaaacaggggaggacaaagtgtggcttcctcactaggagtcagggcaaagttaactgccttggtttccaatggagaccagaactcggttcccctgtgacgggaggacgcagcccagaggaggccgactttctcttcatggtgccttcagacaggaaatctcctaggatttctttctttccctttgatctactcccaatactccctttctgtttcttcaaggtcttttttggatccctactgcacaggacctaaggggctggtgcccttccctaccctccctgcctgggtgtcttcagcacccaagctcacccagaatgttattgcctgccagagacagtgagaggaccaaggagggcagtgggtgcagtggaaccacagcgtcaccatgtacctgtgcctcgtgggatctgagcaaattgaataaacgccccctgaagcttttctgcaggtcacagggaaggggagggtggctgctgacccagcaagagaagcatcaggaagcatcgggggacctcactgtacccctgtaccttgaagacaggcctggctaggctgattttaatgggtaggccgaaggaaaagtctcaatggcaacccaacccccgaccctgagattacagctttcaaatgtctgattgttttgatgttggtcagtagaatccatcccacctttatcaggagactcctttgccaaaattctgagatctgggattcctgctggttgctgcacagaaagccaatcaccaagatgattattgccaaggaaggcactttaatagggtgctgcagtgggggagatgagaactcaagtctcaaatctatctccctgaccagccaaaaccagaggtttagatggcaggaaagaaatgaacaatgtgtaagaaaacaggaactagggagcagcaaggaagcaatcatgatgaacgaggggtcccagcatctcactgtctggatgaatttcagttctttgatagcttttttgacagtcctgaaggtcatttcctgaggaaggaactcagataaaacaaatattaagtttcaagctttaagaccagaagggtccatttctaggtttatccaaaaaagctacatgtgggactgttgggtggttttcagatcaagaaagaaaaagattgtgcagaccaaagtctgaagttaaccaaagaaaaaacaattttctgaccaataggatgtataggatcagagaatgacaagcctatagaagaactgtttttttgtcctgagcataggggaaggatgaagctgcaccagataaggtggaattaagctgcagatgggcaaaaatctgaattttggttcagagccctggggtcttcctcaaaagtctccttccttgaaagaggaaccctgtcttggtttctgcatctctctgagtccttttggaggttgaggatgctgaggtcttggtgcttggccccctctaaccctgagtacttcccctcctgcagggcaacctggccaagtacccaggccccagctccagcgaccatttccccctactttgctcctagcaaaggctatttctaggtcagtggtgaggcacaggcaggacagggcaactcgttctgacatgttttgccctggaaggccttgagcactgcggtcctgcagaaccactgtctccctcttttggagaaagcagggaggaaatgacctgtgtggagggaatcgagggctgcacctgcatggaggagctgaggcaagcagggcagttccagtctgtaaatgtaaaggacatttgtcatccaagaggttgggctgttattattaattttgaattttgtcaaaacaagcttcagggaaattagtcgtcttacttgtaagaaccttacaagacctcccatcttatattccagggagaattgctgcgtattacatgaacacataggtgagactgctgttctgacctgcaggacttgatgccctggcgcaggggcaccagggtaccggcaaagcctttcccatacaaagagcaaggatgttatgtctacaacccatcggcaccagttccaagtacaatttctgctcgactctatggactgagtacacattccccccagcacagaaatcctacaaactcccatgaatgctatagtgaaaagcaggggctggctaggtgtgatggatcacacctgtaatcctagcagtttctaaacttgagtctaggagttggagaccaacctgggcaacatggcaaaacttcaactcttaaaaaaacaacacaaaaaaacaacaaaacaagcacagaaattagccggctgtggtggcttgtgcctgtgctactccaagggctgaggtgggaggattgcttgagtcaaaatgccaccagatacagtgagaccctgtctcagggaaaaaaacaaacaaacaaacaaaaagaggctgtgtaagaggtcaacagaaaaacactaaggttttcaagtggtgttaaaagccagtgggccttggggaccattgagcaatctacaaagcagggaagcctagatccctgagctccacctgccaagtaccaccacagctaatgtgagagacctcccccacagagactgaaatttgcctcccgaggaaacaagtgactacagacatctgtcccaggataataaaaaagaaaacaaggtctcacaaaaacaaaaacagctgaccacaccatacaatcactgagactgagcctgtgactataggtgaagaaaaaaaggctgtctattattcataccatgaaggaccaggggaaagtgcgaacacagtcccctactactgttgtgggaatcaggagaacagagagaccaatgggtggaacaggaggactttattgagtgtactcaggcccagcatattaaaatccaaaggctgagccctgaacaaagacaaggcttggcttttacacacacttctgaaagggggttggctagtttgaatggcgcagtgggaatttgaaggtgcaaaactcacggtgcaggcaagagggcttacagaagcagaacaaaggcagctaatcaaactgtgaccggtcttgcaatgcaagcatagctggtgaccttgcagctgcactgacaggaaatcaggaacttaaaacttgaataataagaaatggtaaggggaaaagagaaggtagtaaagggatttgttgttttttcctcttatccttgctaggggcagactgtgttgagagagtctctggaactaattcctcagggctctggcttttcagacagtgttatcaaggatctgctagggctctatctattgctggccttggagtcagtcaagtactgtgaagctcagttatgcagctgagcttcacacattaggggagataacagagaacagcacatctggagtgcaatggatgagcctcaaccttaggatgaaccactattggtgaccataggatttcccctaccaggtaagtggcagtccacatacctctgccccaccacagctccatatgcctcacctttacacgcatggtcacttgctctgagaaccacccccaccaatctccaaccaccctgagccctcctagccctaacacacagctgggactctcacgtccacccagcagtcctggacttgctcctacagcacgggaaatcctccatggtgaagaagcagccctgtgctacctcatctacatagaaatgccctatcgatgatgtcaccgacaatacctttcttaatgttctgaagattattaaattagatttgtatagttgtgaaaagtgctcatattgctgattccattgcttacatatgatcatataagtcttttctctcctttctgtagtgtggtttaaacttaatccttaaaggacatgtatttgaatttttcagctggttagaaacctgaatataccaatcaaagaaaactgctccttacatgctacagatttggttttcttcctgtactaagatgtcttttagatatagtaaatttgttaaagccaagacttcctatggaacgaagtttgatgggaggggggacattgagtagtaagatcactcttgtaacagggatgccactcttgcagatattgacaactattgggcccataaaatttttaccaaacattggaaagacaagatatgaacaacttatcattgctgcagtctcaaatatcaggaaataccattattctcaggacaataaatagacaataaaaaaagtctcacagagcagattagctgtcatgtattaccaaacagggattggatccttgtcaacaccacccaacagaaattgtccatacaaattcacttcataacatcaaaaccaaaagcccacactgatggcaaaaaataatgacgcaataatgagagagagagagagagagagacctgtcctatagccatacttagtgtgtaaaagccaaagagctcaatttctgctcatgatacttaataaaacagacggaacatgagccaataattcagtgggttcagatctgcaccaagtgcctgttggatgcaggattctactgtctccaataatatgtctcagatggactagtttttttttgttgttttgttttgttttgttttgagacagagtctcgctctgtcgctcaggctgaggtgcaatggcatgatctcagctcactgcaacctctgcctcctgggttcaagcgattctcctgcctcagcctccccagtagttaggattacagacacaccaccacatccagctttttttgctttttttgctttttttttttttttttttttttgtatttttagtagagacggagtttcgtcatgttggtcaggctggtctcgaactcctgacctcagttgatcagaagtaggtgaggtcagaaaacataccctgggaaatgctggcacaatgcccagaaccgccatctctaggcctggggttttcttttgtagtggaatactagtattcatgcaatgcagggacaagaccaattagatacttctgggagttaaaaagagatgaatttacagtgccatttgagaaggggtattaaggaatttgccagggtactgacgcgtgtcaggtgcaaactgcaggttgaaagagagctaagtattttctgtccatgaaggtgataagggagggcctgaagaaagacggaccgggaaggacactggcgccagaagtaggaaagggctgcttgggggtgggaaggatgggtcggggtgctatctaaaaagttgcctggcaatggatgtaggatatggaagcgagacatcaaacaagaagttgtcatttaaataaagtctgaagaaagactagatatgtaaacagcaggagataatagggaaactggaccccgctgctcataaaacttcctgccttatatttcagggaggatcgcagcgcatttcagccaagacaagtaagactgcggttctgacctgcgggcctccacgaattgcattagggcacctgggctccgggaaagccattcccctacacaaagtaagcgtgttatgtctgcaaatgaacggggacactaagagccccaaaggccctgctttcatcccaaagaacagcgcctgtctgcgtagtttgtacctggctctatgaggtgagaacacattccccgctagcacagaaatcctacaaactcctgagggggctgcggttagaagcaggggctgtgtaaaaggtgactctgggggctagagaaaaccacgaagattttcacagagcgtgagaacccaagacactggagaccatggaccaatctctgcaaaaagcagccctgcgtagaaagggaagagctgtacggccttcgcgctagtttgtttgtgttaaggctgacgctccctatttctcctcagtgggagaagcgacatcttaattcctatttcccagccttccactgtaagaataacacgtccaagacacaaatcaatgaaagaaaaaagtagcccttagagtacagcgtattcttgaaactacaaaaaatcaggggaaagcgcgaacgcagtaccactaccacaaattatgcaatcgagtttcccacatttggggaaatcgcaggggtcaacacatctggagtgcaatggataagcctcgccctgggaaaaccaccttcgtgatcatgttatctcccctgccaagtaaatatgagctcctgcacctccgccccgtacgcctcaccctttacacgcacggtcgcttgccccgcgcaccccccagccctcctagccctgacacacagctgggactctccggccggaccagcggtcctgagcccgctcccaaggctcgggaactccttcgaggcgaagcagcaggtggggaagcagcagctcctgcgctgcctcatctacatagaagtcgccctatccgtgatgtcaccgacagtgcctttcccaggccccatctgcctttctgccagtcagccgaccaacccgctgcctgaaccagcaagaggaagtgacgtctgcctctccctttttccctcccgccccggcatctgttttcgcccaaagaagctggtccttagcctatcttgtgaagcaaactttcggtggccagatggagcctgggtactcttcttcacataatgacttttatttcgcagactagaacgtttaggactacaaaagaaaccggttttcttcacatacttatccttgtaatgtagcattccgcttgaaattggaagccgttcaatgtcacagagaaaccatatttatgaaagtaaagaggcttctcagatgactgcaaaccagccttccttactgattttatcactggtaatgttataaaaacagttgtcaagtttaatgaatcttgtagttttttttatttttatttttatttttttccaaattcagtattgtggaaaaatatgctgccacagaagaaatgattggacactctcaaatgtggtgttgcactttgtcatcttttgcacagccatctccagaccttattgcttacctcgtgttagttttttatattctgcaaagacaaaaccaaaataatccaaatttgacaaaaatacctgggatacatcttatttgtgatgcttaacaaatgtctggatcatcttttcttatatgggattataatgcaggaaacactgtgaagtaagcaaagttggaattcccaagtcaaagaccatttgaatatttacaagtagatttgagacaggaataatacagggtggtcacaggataacaaattctaggcagcagatttacatgacttgaggctatgggctgataagatgctgaaaaaccagggtgtggaccaagctggctaagactgactggacccaatgtggtgctggatttgacgtaggttttacctaggccctcattatacgcttattaacatactaaatcacacacccaccagtgccatgacagttctgagaccaatatttgatgtaaaaatggatggcaccacagttctgagaaatctccacctttacccaggaattttcatcaatattccactccttggttaaagaaacccattgagatgaaaccccagaacccattgttctctctcaggtatgcccaaactcccctttcttgagtgtgtactttctgctttgcaataaatctcttctttcactatttgctaactcatccttgacctcattcttgagatggtgtcaagagcctggacaccacagctggggtcgagatcctaccagtgtccggggacctcccccagcccaccagtatcagattctattccattgctcaaatcacaaaacatcaaatggagaattcttctttggagaccacaaagtaaagattctgtggcatggtggccagttaggccactggaagacatggcaaaatattgaaaatgagggattaggtgacagcgtagtaactgctgaatgtgaaatacttgatccagaccccattccctgtagactgactgggagacacattgtccaggtagtagtggagaaatactttctgggtatctgaccagcctttgtggaaagaactggcaccatcctgcagatgtaaccacctgatgggttcttcctgcccactgtacacacaaaatcaattcacggagaccatggcattgcagtaaagagtttaactgacacaggctagccatgacatgtaggggacagagttattactcaaatcaatctcactgaaggcttggaggtaagggttttttcaaagacagtttggtggggagggggctagggcttgggcggtgctgattgttggggatgaaatcacaggggtgtggaaaatggccctcctgcattgagtcagcttctgggtgggagctaagggactgattgattttcgggccaaatggtgccatccagtagtcagaaatgcaaaagcctgaaaagacatctcaagaggccaatcttaggttctacaatagtgatgttcttcacagcagtaactggggaagctgcaaatcttgtgacctctggaataatggctggtgattatttaatgaggcatacatcttagtagaattcaggtccctttcatcctcctaacttggtggcctttcattagttttacaggggtaatttagctttggggaaggttatcattttaaccaaactttttggctgtccccagtgtttttggcaccagggactggcttcatggaagacagtttttccatggaagggggtggtggatagtttccggatgaaaccgttccacttcaggtcatcaggcattagttagagtctcataaggagtgcacaatctggatccctcacacgcatagttcccaatagggttcaagctaatatgagcatctaatgctgatgctgatctgacaagaggcagagctcaggtggtaatgctcgaaagcctgcagctcacctcctgccgtttggctgggttcctaacaggccatggaccaatacctgtcttgtggccctgggggtttgggacccctgatttgaactataaactcaatttttcccaaaaatagcttgggagaaattgtgcaggaatgagcaaagacagctagcctgtgaggctagaaccaaaatggagtcagccatgtcagatttctctgattgtcataattttgcaaaagtagtttcagagggactaccctgacacttgttaaaagcatgaggcggattttattgtatgtactacagtaggcaagagagaccagcagagaaccgagctcaactccaaatacagcaagaagggttgaagatttatagccaatcggcaaggtaagaaagtcagtggatggaaaattactaagaggaacttgattaactatcaaaggtggttgggaggactcttgctaaactaggctcaacagtattcttttctaaaactggacttggcaggccaagaactaatagagaaaagggctcagaggaaactgactaaggtttggtcaaagatggagtccttgtcaactctacattgaagtttctgcaaataaacgaagaccaaccaaatgaaaaaaagtaaaggctatttattctgagcttgctatagcagggagtcagccactgttacttgtgttttggcagagacttgaaggcagtcagagaagtgggaaagctttttacaaagaaaggcttcaggtatgcttcaactggaggctgtcagcatgatgaagctagatagatgaaaaaatcaaaatattttaccccagaatatatttctttggcatattttaagatggccgtcagagagccagcaacagaagtaactctgcaaaactgtcttttataggggaaatttacacctacagagaatctgcattaatctagccttcccttgtcaggattgagaaataaaaataagccctaggccctacagccaactgaacagactccctcttggctgacaggaccgcagagaaaccttgaaagctgtttctggctgtggcaggatagaaggctggacatgcccccttaaaacccctccctcactaaccgcggttatgaggcaggagaacagcagagggagttggaagttggataaaaggcagaatgagtaaaagcagaaacagaagtaaggtgatggggtgggagagcaagaagcaagataaaaggcataaactaagcaaccaaaacaaaaagtaagattaaaaaaagcaagcaaggccaggtgcagctgctcacatctgtaatgccagcagtttgggaggccaaggcaggtggatcgcctgaggtcaggagttcgagaccagcctgaccaacatagtgaaaccccttctctactaaaaatacaaaaagaaaaaaatagctgggcatggtggtgcactcctgtgctcccagctactcaggaggctgagacaggagaattgcttgaacccaggaggcagaggttgcagtgagccaagatcatgccactgcactcaagactgggcaacagagcaagaccctgtcttaaaaaaaaaaaataaaacaagcaagcaaggaccccatggccagcaagatccaaaccaataaaggggcagctcttcagagataggcatgtgcattagagagaaaaagtatccttaacatgacttcatatgataatcagctcattaaagctcatgcatatggactgcatatcatgcatgtacttaaaattatgggatagaggcaacattcaagcacacaagggccaaagtaactaagcaacccacctatcaatcaaatggcaaaccctggctaaagattaggcattcttggcctggcacggtggctcaggcctgtaatcccagcactttgcaaggctgaggtgggcagatcatgaggtcaggagatcgagaccaccctggctaacacggtgaaaccccgtctctactaaaaatacaaaaaaattagccgggcgtggtggcgggcgcctgtagtcccagctgctggggaggctgacgcaggagaatggtttgaacccggtaggcagagcttgcggtgagccaggattgtgccactgcactccagcctgggtgacagagcaagactctgtctcaaaaaaaaaaaaaaaagattaggcatccttgtgaagaaaaaaaaaccacacatcaaaagacccaatgtacaccaaactaatactgatctcatctcccagaggtcagcccactctccccactccgagagtgttactgtgcttaataaacttttgctttgctttgctgctttgtgtgtgtcatgtacacttctttgggacaccaacagtctggaactgcacggtaccatctggtaagaattaggcttttttggccgggtgcggtggctcacgcctgtaatcccagcactttgcgaggccgaggcgggcggatcacgagatcaggaaatcgagaccatcctggctaacacggtaaaaccccatctctactaaaaatacaaaaaattagcccgacgtggtggcgggtgcctgtagtcccagctacccaggaggctgaggtgggaggattacttgagcctgggaggtgaaggttgcagtgacccaagcttgcaacactgcacttcagcctgggtgacagaggaatgggccttcactagacactgaacctgctggcaacttgatcttagactgaccatcctccataactgtgagcaataaatttttgttgtttataagttactcactctgtggtattttgttatagcagcacaactggattaagacattaacctgaccttaagaaatcatctcaaatcagtcttggctttgatgagaaacaaagggcacactcgaatgtgtgatttaaagagagttttttttttttttgagatggagtctcgctctgtcccccaggctggagtgcagtggcatgatctcggctcactgcaagctccgactcctgggttcacgccattctcctgcctcagcctccggagtagctgggactacaggcgcccgccaccacacctggctaattttttgtatttttagtagagacggggtttcactgtgttggccaggatggtctcgatctcttgacctcatgatctgcctgcctcggcctcccaaagtgctgggattgcaggcatgcgccactgcacccggcctacagagagttttatgaagagaatatttataaatatatggacaggatcaaaataacgcaagaaaggactgagaggcactcagaatctggaatcatcagagaagttgtattgcctctaggactgaattgttgtataagtctgttcaggttgccataacaaaataccatataccaagtggcctaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcataaggaccccactctcataacctcttttaaacctgattacctctcagaggccccagctgcataaaccatcacactgggggttagggcttcaacatttaagtgtgggagttggtgttcacaattcagtcaattggagtggaaattgaaatgggaaaggaaaactatagttactagagagagctattgtcttggagaggatcactggacaggactatagtctttggagaaataagtgagtgacaactgacaaagattctttctgtgaaaataagtaatttaaaatgtaagttgttggaattccaaattactttgagcctttaaaaaatctgagtatgggccaggcaccatggctcacacctgtaatcccagtactttgggaggcccaaggcaggcagatcacgtgagatcaggagtttgagaccagcctgactaacatggagaaagcccatccctactaaaaatacaaaattaaccgggtgtggtggcgcatgcctgtaatcccagctactcgggaggctgaggcaggagaatcacttgaacctgggaggcagaagttgcagtgagctgagatcgcaccattgcactccagcctgggcaacaagagtaaaactctgtctcaaaaaaaaaaaaaaaaagaaaaaagaaaatgtgggtatggagcctaagtcacatgagaggcacctgtaaactaggcagttttaacctttgtttctctgattatagattggccttcttccttacatacattttttttttttttttttgagatggagtcttgctctgtgggccaggctggagtgcagtggcatgatctcggctcactgcaaccttagcctcctgggttcatgccattctcttgcctcagcctcccgagtagctgggactataggcgcacaccaccatgcccaggtaattttttgtattttagtagagacggggtttcaccatgttagccaggatggtctccatctcctgacctcatgatccacctgcctcagcctcccaaagtgctgggattacaggcatgagccactgcacccagccacacgcattgttttctaacatgtcatataaattattgaagggtgccagggaagattgcttccctcttcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtaaaatcccatctctagtaaaaatacaaaaaattacctgggcatggtggtgggcacctgtaatcccagatattcaggaggctgagacaggagaatcacttgaaaccaagaggcagaggttgcagtgagccaagatcatgccattgcactccagccttagcaacagagtgagactccatctcagaacaacaacaacaacaaaaaaaaaaaacacaaaaaaacaaaaaattctgcaactaattaatttgttgtaactcttaaagcagccttatatagaaaatgttgtgatcctattaatttttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacactgaattctgaacctttcatttatttcaggttgacatctccttggccaaactctaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcagcccaaaaagggactctttcctgtttattattgcaaagccaatgtatgaaaccaagagtgagtgtcaagcagtgcaggctctattcaatggcattggagaagtaggagcatagcatggaattggagaagtagtatagcttgcaaatcaccttctcggctactgagaaccaggaagttacaaatatagaggatctttaatgaagggaatgagcaaggtgaggaatattcatgcttttcttaggaagggatggagattttcctagaatcaaggagtcacctcatttctgtcctttcttggtctctttcgttcattgtcacagtgattgtcaactgtcatgcactgatgggagtgctatttagcatggaaattggattataataaagctagatgtttttcagaggttgcataagctgccatcatggatttcaccagcttcagctggtttagtcccaagaagaaacttctgaccacagacatcctgtttcttaaaaataagcagagttaaaggtgagtaagaattcagccatgacacatatgcactgcaatggccaacaacatctgggtaggggtccaggtaagtcatgtaggcagtgcaataggtaacacagtcacagaaatacctatgaaaagctgtccttttgtcagggagattagcatgtgtagaggaagtaaacatcaactgcaaatggctttctctgagaccttcttatctgctttatccggatccaggtaagattaactcacaggaaaaggaaacaaaagatctcatgcttttaaacgtctgacagagaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattatttatatatttatttatttatttatttatttatttatttatttattttagacagagtcttgttctttcacccaggctggagtgcagtggtgccatctcagctcactgcaagctctgcctcccaggttcatgccattctcctgcctcagcctccctagtagctgggactacaggtgcccgccaccacgcctggctaatttttttgtatttttagtagagacggggtttcactgtgttagccaggatggtctcgatctcttgacctcatgatccacctgcctttgcctcccaaagtgctgggattataggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctacttcttgagagacttcatctgcatcacatctgcatcacaacacagcctttgctcaccatgtctttcctcccctcaacctcccataacctgtggccaccaccccctaagaactccaagcctagttagtcctttttgtgctgcacataaacttcaaccatacggccttctttgaggcttttttttttttttttgagacaaagttttgcttttgttgcccaggctggagtgcaatggcgtgatctcagctcaccgcaacctctgcctcccaggttcaagtgattctcctgcctcagccttccgagtagctgggattacaggcatgtgccaccacaactggttaattgtgtatttttagtagagatggggtttctccatgttggtcaggctggtctcgaactcctaacctcaggtgatcaggatccacccgctttggcctcccgaagtgctgggattacaggtgtgacccactgtgcccggcctgaggctcatatttttatgtgactctgtattagtcagggttctctagacagacagaattaataggatagatatacaaagtagtttattaagtattacacttactttttttgtctttttttttcttactttttgtggaaaacagggtcttgttatattgcccaggcaggtctccaactcctgggctcaagctatcctcccgcctctgcgtctctgagagctgggattacaggtgtgaaccaccacacctggccaggagtttattaagtattaacttacacaatcacaatgtcctgcaataggctgtctgcaagcttaaggagcaggaaagtcagttcaagtctcaaaactgaagaacttggagtctgatgttccagggcaggaagcatccagcacaggagaaagacgtaggctggcaggataggccagtctggccttttcatgattttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacctgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggtccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagaaagggtacaattatctatgttgcaagctagcttaaactaaatttctttgtggagcggggaaggggtagatgagggggcccccaccgatagatgcctggccactgggtgaaagggaaagaaggaaggtggagggggtggctcagtacattctgcttctttatttctttctttccaggtagcctgcctaaacctataccaagccacttagaattgaaaatagataatcacatataggttatttcctactattccctcctttttctttttaccctttttggtgtcattttcacttaaattgctttttcaaactgttccagaattgtttacttttttttttcagatggagttttgctctgttgcccaggctgcagtgcagtggggtgatctcggctcactgcaacctctgccccccaggttcaagcgattctcctgcctcagcctcccgagtagctgagattataggcgcgctgtaatttttgtatttttaatagagacagggtttcaccatgttggccaggctggtcttgaactcctaaactcaggtgatcatgagcacctgcttcagcctcccaaagtgctgggattacaggcgtgagccaccgcgccaagccagaagttgtttactttctttctcataggaggaggagtttatttggtttctaataatagtaggttattttgttggaacatcaggggcatctgtttactgagagttgttttaataaaccttagtgttatatatatatatatacatatatatataaaatatattacatctattatatatagtagtagtgttaaaccccttacacaagtattgatgcaacatcgtatgtcaatgacagaatctgttaagttggaagagtatactgtagaaggtacatacttcactttttttttttttttttttttgagatggagtcttgctctgttgcccagtctggagtgcagtggcgcaatctcagctcactgcaaccaccgcctcctgtgttcaagcaattctgctgcctcagcctcccaaatagctgggattacaggtgcccaccaccacatctggctaatttttgtatttttagtagagacagggtttcactatgttggccagactgatcttgaactcctaacctcaggtgatctgcccgccttggcctcccaaagtgctgggattataggcataagccaccaccctggctcatagttcactattgaaacaaacttttttttgtgtacagaagaaaaaaaatcgtacagttaacagtgtcagagatagtgaaaatatgaaacaagaactgcttacaagaaaggagcactcaggggaccaaacctctgccagagccagcggggaagtgacttatgcctctctcttctttccctcctgtccccgcccctcgtctcccgcaatgaagcgggtacttaatctgtgtcctgtggaggtcccctttggcagccagctggaagcccgtgcacccttcttcaaataatggctttcaatgagcagactaggacgtttaggattgcaaaggaaaccgattcctttcaaacctgattatctttgtgatgtggcactgtttgcatatcttccttaaaatgcattaaaggccactgcactccaccctgggtgacaagaggtgactgtgtctcaaaaaaaccaaaaacactcccccctcaccccaaagcattagacgtcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcgtatggaccttggacatctaccttcctgaacttttctctcctgtttttacattattattttggtttgtgggaaatattcttgacattatcttcaacttaatttttgttcttgcttctactattttagtttaatttccaagtattttgatattgaactttcaagagaacagacatccctgccagccttgacgtctaatgctttggggtgaggggggagtgtttttggtttttttgagacacagtcacctcttgtcgcccagggtggagtgcagtggccttcaatgcgttttaacgaagatatgcacacagtgccacatcataaagataaccaggtttgaaaggaatcggtttcctttgtaatcctaaacgtcctagtctgctcattgaaagccattatttgaagaagggtgcacgggcttccagctggctgccaagtgggacctccacaggacacagattaagtacccgcttcattgcggcagacgaggggcggggacaggagggaaagaagggacaggcataagtcacttcccccgccggctccgacagcgggtaggtccgctgaggggcgttgggtgaggcggaagagcagacggggatccggaaggcgttgtcggtgacatcacggagagggcgatttctatgtagatgaggcagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaagggtgaggaatatgaggctgcggcggggcggaggggtgtgagcttatacttatatttatctggcagaagaaatgttatgatcacgaaggtggtttttccagggcaaggcttagcaattttactctggatgtgctgacccctgtgatttccccaaatgagggaatctcgactacataatttgtggcagtggggaactgtttgtgctttcccctggattgctgtcgttttaaaagtggattttgtttgctgtggaagcatatacaacgcgttagtataaactaataaacaggtctttgttcccatctgtcacttactttcaaagtaaagattttgtcaggtagtggttggttctcacgcttgtaatctcagtagtctgtgagatgcattgataactttatgttaataccgctcgagctctggagtttgatgtcagtgtggtcaaatatggtggacccgtctctactaatctcttaacttttttttttgttctatagaaataaaactaagcttttcttttccctatgggagcccactgtaaacatttattaacagcaaacagttcactggagtgcatggcttactgcaacctctgcctcctgccttcaagctattctcctgcctcagccagagaatactcgatctcctaggtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaagtgtcttttttttttttcccagtgtggcccaaggaagccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtgacaaaaccctgctggaatcctgcaacttctaaccttaatgttagatcaagaagcaaaacacccaccagtccaagggtcagggaagatgaagatcatgcctgagctgtaacaacgcccttcccagtatacaaaagcgtgtaacagccactcgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttttttcttcctcttcctcatcctcttctttctcttcttcctcctttttcctccttgtaaagccatacttaaggttcagataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaattattaatgaatatgatagcgaggatgatggaagacgagaattctcaagaaaagtattggttaacatataaccaaatgtattcatctcaaaataatgaagaaatactcctaactattacaagtcctcatttctgcaactgtcactggccctagctggtatttgtaactatctttacatcttgctctcacagccatttcctttgggcctgggccggtggacgtgagcgtgggaaagaccagaacccgcggtgccccccaccgcactatcctcgggtctccagaggtgggatccactgggcaggggcctttgctggattctaaaccggctctggggatacaagaacagctgcctttgagaaacagttcaggtctctatattccagacttcttagtaggactaaacccttaattttcacccgggaattcatggttctcctaaaaccctgcggtggaatgccttccttcaccgagcatttattgggcacctactaggtgctagggtggctctgggcgaagggctgcagcctgtgcaaactccaggtccctttcctgtggatcccacctctgaggacccgagggggacgcagtgaggacaccacgggttctggtccttcccacgcgcgcgtctgctggcccaggcctggcagaaatgactgtgagtgcaaggtgtgagcggggctaagaatgggaaagagagtgactttcgcctgagaagctgcagttgtcgcctgtagaggggccggcgacttttgagacggtgaagagcaggcggaggaagcagtgaagagcagacggtgaggagcaggtggacctttggccgttggagtcccccagctgactctgccagagtagaacgtccaaagtgcccaaagactcgactcttggcttcattgtctcccgtattatgggtttctggagtgcgcgggattggacaggcatcaaatacatgagattatctgcagccagaggttaaaaagccatttctggtatcagcaaatgagtttaagacacaagccattggagtctctgtggcgcaatcggttagcgcgtttgactgttaactgaaaggttggtggtgcaagcccatccagggatggcaccttttgcttaggcaagattcacactttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacaccagagccactgcacctatttcatcacctcctgaagctgggtttttacaattgcacattcctggaaatccaaaactcccaataattgaaaacaagaaaaccccagtcttcacttgtggtgaagcctcaatttctgggttgaaatcttggttcattcatgacgtgacttttaaaaccttactggattttctgtacctcaatttcttcgtctataaaaaagagcagccaggcgcggtggctcacgcctgtaatcccagcactttgagaggcccaggcaggtggatcacctgaggtcaggagttcgagaccagcctggccagggtggtgaaactccgtctttaataaaaatataaaaattagtcaggcatggtggcgggcgcctgtactcccagctacttgggaagctgaggctggcaggcacctgtaatcccagctactcgggaagctgaggcaggagaatcacttgaacccgggaggcagaggttgcagtgagccgagatcatgccattgcactccagcctgggcaaaagagcgagactccttctcaaaaaataaaaataaataaaaaagaaaaaagaaagaaagaaatttttcctggcacatttctatatgttccattctggatgacttgctcttcaggcttatctcacagctgttatcataatatctctctttactgcaccatcttgggatttccatgacctctctcttgttagatcccctgcttcatggatctcaagggggtgcattcctcactcacttcttccttttgatgatgcatatccttcaagacctcctataaagtggttaccttagaaataaactttttgagacactgcatgtctgaaaatgtcttttatacccataaagttaattgatattttactagatagagatacaaaaagataggtggaaataatttctctctgagatttttgaaggcactgctttttttttttttgtgacagtctcgcctcgctctgtcacccaggctggagtgtggtggtgggatcttggctcactgcaatctccacctcccaggttcaagcgattctcctgcctcagcctccccagtagctgggactacaggtgcctgccaccatgcccggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcaggcctggttgttaaaattcaactgctgacctcaccaattgtgctgtctgtaaattccagacattgtataaaaaagcattatgaaattcccttttctgtcctgtttcattctgattaccagtacatgcagcccccagtcacgtacccctcgcttgctcagttgatcatgaccccccccccatgcagcccctttagagttgtgggcccttaaaagggacaagaattacttgtttggggagctcggtttctaggatgtgagtctaccgatgctcccagctgaaaaaagctcttaccttccacaatccggtgtctgagggattttgtctatgactcctgctacagtttcaaactcctgacctcaagtgatccgcctcccttggctttgcaaagtgctgggattacaggcctgagccacaacaagagctcccggcccttgttgtttactgctttccatagtcatttctgagaaagagaaaggtaagccttttctgctctgagctagagctggtctgacaaacacctaggccatggtgttgtatggttaaaactaaaaatttcacaacaccaatatcagacaaagttaccccctcactaaactgaaagaaatactatttcacaatcatatttgagcataaaaagaacactgttcaaaccataatatgatcaaacatcccagctactaatagtgacggttaattattttattttttatttttttgtgatggagtcttgctctgtcaccaggctggagtgcagtggcacaatctcagctcactgcaacctctgcctcctgggttcaagtgattctcctgcctcaaccttccgagtagctgagactacaggcacctgccaccacacccagctaatttttgtacttttagtagagactgggtttcaccatattggccaggctggtctggaactcctgaccttgtgatccgcccccgccccgctcagcttcccaaagtgttgggattataggcatgagccactgcaccaggccatttttttttttttttttttttgagacagtctctgttgcccaggctggagtgcagggccgtcatctcagctcactgcaacctccacctcctgcgttcaagtgattctcctccctcagcctctcaagtagctgggattacaggcatgcccaaccatgcttggctaacttttgtgttgactgttgattctttaccaattatgtgtttagtcttgcaaccatttctctcactttctagataaaaatatcgagattcccaaaggaagaattgtcccacaatttccccatagtgtttgctgtctcctctgttgcaatgagccaatatactcaggtttgactataggtttgttcctgatggttacacactggagcacatcagcaccatagagaagatggatgccgttctgattctttgttatttgccttaaacttttctcccatctcccctcccaaaagcctatagaatcttctacctcttcctattagtttgaaacttcatgatctatttccatccaccatgctgggtactcagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaatagcaataattggctgggcgcggtggctcacacctgtaatcccagcactttgggaggccaaggcgggcaggtcatgaggtcaggagatcgagacgatcctggctaacacggtgaaaccccgtctctactaaaaatacaaaaattagccaggcgtggtgccgggcgcctgtagtcccagctactagggaggctgaggcaggagaatggcatgaacccgggaggctgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctgattcatttggggctggatggtctaggatggcctcacacatctggggtataggtggattggttggaaaaagtgggatgcatggatctttttcttcatgtgatctctctagcaggctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatggccaattcaagattcaaagagaggagaaatagactctcttgatgagagaagctgcaaaatataaccactttttttttcaatctatcacagtataccatactggactatcagtagcttcctcatttttctttctttctttctttctttttttctttctgagatggagtctcgctctgtcgcccaggctggagtgcaatggcgacatctcggctcactgcaagctctgcctcccgggtttagccattgtcctgcctcagcctccctagtagctgggactacaggcacccgccaccacagccggctaattttttgtatttttagtagagacggggtttcaccatgttagccaggatggtctccatctcctgacctcatgatttgcctgcctcggcctcccaaagtgctgggattacaggcgtgagccaccgtgcccaatgaaaacctttattttcgtgatggctgcttatttatttatttatttatttatttatttatttatttatttttctttccctgctctccctctttttaaatttttattatttatttatttattttttctgcagagatttatccaattcagaggtcttgtccccataatttggaactttcctttggatttgatcaagtcagatagaactggtcaaacccaatggggaaaagaaggaaacaacaataaaaacacaaacagaaaacaaaaaacagttcagaaaattagtgatcgcacaatttatatgattgcctagcactctaacggtaagaagaaattataatcagttggttgttaatcttttttatttttttattttttatttttttttgagacagagtctcgctctgttgcccaggctggagtgcagtggcgcgatctcggctcacagcaaactccacctcccgggttcacgccattctcttgcctcagcctggttgttaatcataactttaatcatttaggagaatttccaagacaaaacacaggttcagttacttacctaggaatggggcccaggctgaagactgctctgtaccatcttagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaagcttagatctcaatcaaattttgggaaatcagggattctctggagggggtggatctctgaggcctcagcaaattgtcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaggtatagcagccaggtgcaaattgtgggggcctggaaataattttggtataacagagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccagtcgctgtttagccctgatttgcatatgagactttgtgctggtcatctggtaacttttcactcggcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactatgaggtgggtgatgattagagcctggattaatcaagggcctgtggcttctaacaccatcagttgcctgtactcagccaccttcagcagtgctatctggctctagagagccatagcattccaggaaaggagagaaggctgcacaaagccctgatgtttgtgtccccccatctagacagacataatagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcagcaatgaagagtttcttcctcattgaatcactaacgcgttttggatctctctgacttcctagtttgctgacctctgacctctagatccagactttaaaggcccatgttattagattagtcaacctttataatctccccattttaaggttaattgtatctgcaaaatccctttgccattcaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgcattatctgagttcctttctcaggaaaccaagcgttgggccctccagatagtatcaaagaactgaaatttaccagagtaccacatctggacaatgaaatatcagaccccttatcccatcaaaattgcctaagtgaccacctgcttcctgttgaccaattcctctttcttacctctccctaattcctgttttcctgcatgtagttccatttcttccctgctatctaaaccctgaattttcattggtcaggaagatggatttgagactgatctcccatctcctaagttgtagtacctgatgaaagccttctttcctagcaatgctagttggctcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagattacaattataaatacacatgcatctaatagagcctcaaaacacaggaagcaaaaactgacagaattgaagggagaaatagacaatttaacaatagtagatggagactttaataccacaactttcaataatggatacagcaactacacagaagatcaataaagaaataaaagatttaaacaacataacctaccagacatctatagaatactccactcaacaaaaacagaatacacttcctctcaagtacacacgggatgttctatagaatagaccatatgttagcttttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctgtaattccaatactttgggaggccaaagtgtgagaataacttgggcccaggagtttgagacccacctgggcaacatagtgagaccccatctacacaaacacacacacacaaaaacacacacacacgcacacaatagctgagtgtgatgacatgtgcctacagtcccagctattcaggaggctgaggcaggaggatcacttaagcctcggagtttgaggctgcagtgagctgtgatcatgccattgcactccaggttgagcagcagagctagaccctttctattaaaaaaaagcaaaaaaacaaaaaactaacatgcttccccagtgggggaaaagatgtcagtataacattggtttgcagcaagaagtatattaagatattgatcaaaatccttttattatttattttgtttttattttttgagacagggtctcactttgtcatccagaatggagtgccgtggcatgatcttggttcactacagcaaaacacacctggacccaagcttgcagtgagcaatcatgtctcactgcaagctccacctcctgggttcacaccattatcctgcctcagcctcccaagtagctgagactacaggcacctgccaccacacctggctaattttttgtatttttagtagagacgaggtttcaccgtgttagccaggatggtctcgatctcctgatctcatgatctgcctgcctcagcctcccaaagtgctggaattacaggcatgagccaccgtgcctagccctatgcctggctaattttttaaatttttttgtagaggcagggtttcgtcgtgctgcccaggttggtctcaaactcctgagctcaagtgatccaacaaccctggtctcccaaagtggtgggattacatgtgtgaaccactgcacctggcctctaaatcgatataaatcaattattcacacactgagaggaatattcaggatttttttcttataatataaatgatgtgaaaatctggagaaccaaagaagaatgccaagactatctaaaagtgttaaatttttcattaggaagaaaatgacttcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgttgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttaggtacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacaaactataaaatttacccattataattgtacagttgaataatttttagtaatttacccaagtagtgcaaccattaccataatccatgcatttgtttttaatttattatttgtctgggttctgattctacttcctcaacaagctacagcatggcagtatctgccaccacttgttttggtccaagggcagaaatcagtatcctggaaaccaatcagtacttgcgctctgaactggaaaagtgcaaacagaacttccaagacctcacagagaaattcctgacatccaaagctactgcctactccctgaccaatcacctgcagaaatatagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggcgagtgtagtgaggaatagagactaaaaccttggtttaggcctgaaactgtctttcccctctcagcaatgaatatcagattctacaaacatgtaacatcactgttggttaaaacatctcaggattcgatttaaacttttttaagagcgcccatttgcaaagcactgtgccaacagcatcagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacatgttactaatagtcagggaagggaagctgtaatgacaaggaaacgtgggaacaagggcatgagaggaacagggatattagaagaggattctggttaacatagaaattgagtttgttttccaatttctacaattattttaaaatacatcattgtgtgggggtggctaaaagttgctgtctaacttactgtcatagaaaagtaaagccaaaagcccacttattaaagaagtgaaaagatgagctttggtgtgtggaaaaactagtttaaaaaaaaaacccttcactcattataattgtaggaaaaaaatttctcaagctagagaagaagaaagatattacctaagaccctaatataaaggtattattgtgcagtgattaaagagcatataccctagggccaaatttcctgggttcaaatctaacttatcatcactgtccctcagttttctcatctgtaatggtaatagagtaggaactacctctttggatggtggtgacgatcatatgatgataattcttaaaaacctactgcaacagtaccgtgacaaacactatgtgttggttttccctttaaaacaccacctactagcttttgggcatatatcatttggatctttctcctctatatacagttttacacagctgtatacagataaatgtttaaatctttgaaatattttgggattattgaaactcctgacacaggagggccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtgtggtggggcacacttgtaatctcagctacttgggaggctgaggcaggagaacaacctgggaatcagaggtgcagtgagccgagattgtgccactgccctccagcctgggcaaaaaagtgagattccatctcaaaaaaaaaaaaaaaaaaaaagaaaagaaaagaaaaagatgtggcgtcagatctcaggggatgtgaattctgactgcctcattccagttgaatcatcttgtcaagtgattttatcaacctgtgggcttttctttcctcatctctaaaacagggagtagttgagagactgaggaataaagatatggaaatcccagtgtaaagcctcgtactggggatacttttatccttgagatagaccctgcctcctgctctgcaagcagtgaccacagcaacatggccagccttccatgatgcaggcatgtctgtcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagcagggcagctcaggctggtagaacaaagagcaaatttgtgcaaggagaagggcagaaatgtatgactcaggcacagaactagactaagacacaatgaggctatggtctagttaggtctctagggttttccattaaatagcatattagtaaaatggagacagctgcctgcattggaatactagcaatgtggcttctatttgtgtgtccttggtcaaatttacttcacttttctgcgtgtcattaacctaggctacctcatttataaaatgcaaatactgacagtatctactcagagggttatgaagattaaatgcacaattgcaagtagttagaaccatctctagcacatataaaactctgaacaactattttctgtaattattatatttgttcccatttatagatgtggtgattgtcattaatattttctataagagatattttcaaactttccaaagtgcctttcatgataacaatgtttctcctccaaactttttaaaaaagtattatactaggtggagtattaactggtagggctattgggtagatagatgattgagcagctgttgtgtggaaaatgaattattaattcgctcaggaccagcattgactatccttagagggtttcagacataaggtagattgtagcattcgaaacttcttttaatcctttgttgaaatgaaatcatagaagctcaaatttctaaaactcaccaaagcagagatatttgattgaaggtgggataggtctggagcccctatttctccccagtatgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgtgtacatactaccgggtgctgtaagttgggtaataggtagcactatctttagactcacagagctcacactctacattggaacccatgtgtattagtctactctgacactgctataaacatatatctgagattggtgatttataaagaaaagaggtttaatcggctcatggttctgtgggctgtacaggcttctgcttctgggcaggcctcagaaaacttacaatcattgcagaagtcaaaggggaaggaggcatggtcttcacatggccagagcaggagagagagagagagcaaagagggaggtgctacactttcaaacgaccagacctcatgagaactcactcactatcatgagaacagcaagggggaaatccaccaccatggtccagtcactatccagcaggtccctggttggattacaatccaacatgagatttgagtggggacacagagccaaaccatatcaccatgagaaatatttaaacaataattagaaaaaaaataaatccccacagagtaatgaaattactactcagaactttactttttttctttttttgagatggagtcttaccctgttgcccaggctagagtgcagtggtgtgatctcagctcactgcaacctccacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcgtgagccactgtgcccggccagaactttagttttaactgccttcttactgattatagtctatcttcatgtcattcagaagaacactgcccctcttgaccttttcactgatttttctttttaactttcaattaatactagggataccggcccaacagttttgaacttggcttttttttttttttttttttttctgccagttactgcatatgaaaagatacttgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacaccgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggaggcagaggtggaggttgcagtgaaccaagatcacatcactgcactccagcttgggcaacagagtgagaccctgtctcaaaaaaaaaagaaaaaaagaattcaacttgggagttccttacagggattctaagagatctctcctctgaaacttctataacctgttattcactacattccctcatacattttactcttctttcccaccttaggatacatgatcccttaattcaggctcaggctgaagaactgacccacttacgacagaagacacaggaagggagaggtgtctgctacctttttacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgtcccaaagtggggagaaaaaatgcaaacttatctccattgtagattttattttagttttgactatggtccttaatctgcattctattgttttctctttagagcactcaggtaatcacttttcatattctttcaagaattctaagttttgttttttattttgagacagaatcttgctctcttacccaagctggagtgcagtgacacggtcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggcttgtcttgaactactgagctgaagtaatccacctgctttggactcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccgctgtcttctggcttacactgttccaacaagaagtctgccataattcttatttctgtttctctgtacataatatgtcttttttctctggatgcttttgagattttctatttatcactggtttgaagcagtttgattaagataagaccttgtatagttttctcttttacatattgttctactttatttagtttcttgcatctgcatgtttatagttctcatcaaatttgaataataatgacatatatagtcttacctatggcatatacaatatattatatttcgcatatatacggcaaatatatataatgtatattctattctttctctctatcttctcctttaaagactccagttatatttgtattagctgctttgaaattttaccacagctgactaatggtctgttcatttttgttgtatcttttctttctctccgtttctttctatttccatgtcttggaattgattaatctttcttcagcagcatctaatctgctgttaatcctatccagtgtattttcatctcagactttatttttcatctaaatttaatttatgtcttttttttaaggtcttctatgtaactcttcatcatttcatattttcctctagcttctttattttattttattctattttttgagacagagtctcgctctgttgcccaggctgaagtgcagtggtgagattttggctcactgcaaccttcacctcctgagttcaagtgattcctgtgcctcagcctcctgagtagctggaattacaggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcttttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctttccaagctggctttttaattttttttaggcaggataagagcagctattagtcaactgctattttctttcccactatggaggcaaaatgacctttaagaaaatagaccttattttttagagtagtttcagattcacagcaaaattgagcaggaagtacagaaagttcccatataacccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcatgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccaatgctaatctaatgccatcgttgatctgacaggaggctgagctcaggcggtaatgctttctcgctggctgctcacctcctgctgtgcggtcccattcctaacaggccatggaccagtgctgggggtttgggactcctgttctaaccaatgctccctctattaaaagggattttcacactagctgatggaaacaccaagtgttgcaagctctgtgtgagctacagagattattccttttgggaagttctttgccctgctttgcataatttcctcaaatacatgtactaataagtacttagctgaagattgaacacagatatccaaggcattctctctgtgcagcaacctattctctagtctgtcctgtgatgtctagccaccctgacttcttcaaacttactaccaggctctgcctgggtcctccttccctgctctgcagttgacaaactcaggcagcaaactggagcactcatagggctcatctcttctattttctctctctcagggatcaatgtactgtactgcactatatccaatgttgaagctagagtttaaaatactttttccagtttcttagttgtttaaggtggaggacaaatctagtccctattactccaacttggccagaagcagaagtctccattccatctttgtggtcagaaagaacagtatgacagaaggcagcttgttagaatagaaagatccatggactaagaatcagaattacctaggctctagtctcagcactgtatttactaactttgtgcaagtgattgatccctcctgaatttctgtttcctcatttgtaaagtgagtcaaatcataattccacggctgctgtacagatcagttgaagtagtatcttaatgttcatgagtgtatttctctttcagggttatttatttatttatttattttcaggtcccaatagactgtccaaatcttttggggttagttcaggctctgtatatagtagaagctggtgttagaaaagttgatttataccggaatatttttcatagaatcacccccaattctcaccaacaaactgagaagaaaaaaaaaagaattacccccaagaacatctgaggaagcacaacagggacagacttgaaggtacctgggcagtcctctggttttggagtagaggtaggacagggctatttgtcctctcagagactggagcaggttctgtgtgtgagtagctatgggacaaacagtcatggtctggcaaacagcctgtggcaggaaggaaggttacaactggagaagtccaaagggcagccaggcaagtattctttgagctggggaacaaaagacattttaaactttttgctctgcttcaggcagctgatgtcatggtgatgattcaccacatcaggaacaccctgtccagtgggctcaggcaagcctgccaggccacttctctaaagacaccacctgaggcctcctgcaataaatctcacagagtattctgaacacacatgtaaagtgttatgtccctgatcatataggccccatgtgtgcaatgtgtgaaatgggacttgcctaatttctgactagctctttctaattttggtttgcagaaaatcacaacggtaagaaaaatgaagacaggcaaaagccactggctcctaggtaactctatatgatgaaggggctgataatggactgaccaaatctagagaggattccagaagcaaggactcaagaggttaaaggtcccagatatagaaaaagcagaaactgctgattgttcctttttttgttgactgattatacaatgtgtccttttaaaaatggttctctgttctctttgcagttcttgtattggttcctagttcctactaatttctcacacttagttaactagtcagtcttactgaaaagtaaactaaccagggatccctggtttctgtatctttcaaacctatagggttacaaaccaaagtgagatgcctatctggtttctgcacagttgtcctgaattatgttggcagatattttatacctagaaattcaccttgaaaaataaattgaaaccataccaagtatttagagctaggggtctaaagtctgcaaaagccctgggaggttgcgttgtctcaagagccagtattcaatggaccactccacatcatagtaaataaaatttgaacacagcattttgaagccaatagtatgggtctctgtgtgtcctgtgtgccctgagtgtattttagagtagctgttgagtctgctgccttatctgtgtgttatgaggtcaatgcactgatcacttgctgttttcacttctatactaactctaggcacactctactcccggtcaaaagtggattgtatatgtcctctttgatgtgatggtccctttggttttggtgcctcttccatgagcttcagatcagaactagctatgtggttccaggctgccttggtttcatcccttgtcttgcctacttcacctggctcaggagggacatcaaggaggaagaaatggataaagtcctggagggacttcaaacagtatttgacccattccagccgccatgactcccaccagcttcgcagcagcaatgccttcctctttgatgcacaggaagacccctctgctctggatatagccagtgagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaagtctcaagtacaggtccctggtgggtcaggtaatttgctctgttcctgtcctcacctcagtccctctggccccaactggcatctgcaagccagtatactcaaagctggccagaatgaagagagtgaagagattatggcagactctctgccactactgccacacatgtacaaatccgcttaacagatctccttctttaaaatgggacatcttatctttcctgaaatatatatattttttgagacagggtctcttgttctgtcacccaggctagagtgcagtggcatgatctcggctcaccacaacctacaacccagggtcaaatgaccctcccgcctcagcctcctgagtggctgagaccacagatgcatgccactactcccggattttttttgcctttttggtagagacagggtcttgccttgttgcccaggctggcctcaaactcctgagctcaagcaattcacccacccctgcctcccaaggtgctgggattacagatgtgagccaccacacccagccttcctgaaatattcttgataattatagttcctgaacagttttcccaagctgttctagccatcccaagaatgttggcaggcttctccatatgtttggaggtgtaactataatggttcctgggtttcaagctccagtctccatctcccctcaggtgcttgctttcccataagtttccatctgactactagaatatcaggggatttccataaagacaagactttgatcttggcaaccctttggtaaatagccagggttctcaatctttgtgcagcaccaaggtatttttaagatctctgttagtttagtctcagtgttgtaattcaatctaaataaacaacgaggctatctgctggagaaaaggatgaatctaacagcaatgccaccagcatgccctcttcccagaaaaactccacgctagccattggagcttctttaggtatataagagccctttaggttggtaacctcactggtgtgtgtatagattaaaaccttgacctatatctcctctcccttacttgaatgtttgactttactttgggggcaaaagtttggattgttaggggactatatgctttatatactcttctatgcaatagaaagagattgtattaattcactcattgagctttcacagtaatataaaccatattaggcttgtcattctgtcagtgatgggtgtaagtttgtggcttttattactcataccatcctctgacaaaggcatcctatttctctttccaatttcacaataaggtgcagaagaaggtctttaccatctgttaaagatgttcagggccgggcatggtggctcacacctataatcccagccctttgtgaggcctaggtgggtggatcacttgaggtcatgagtttgagaccagcctggccaacatgctgaaaccccgtctctactaaaaatgcaaaaattagccaagcatagtggtgcatgcctgtagtctcagccacttgggaggctgaggcatgagaatcctttgaacctgggagatggagtttgcagtgagccaagatggtgcctctgcactccagcttgagtgacagaatgagactgtcaaaaaacaacaacaacaacaaaagatgctcaggagagatgttttgtagagaggaagatattccctagtacccataaatcatctcaaggaggtggtcatatctttcctagtgctagaaaagccctattcagaaaccttcagtgtttttccacctcctgtcaacctgccttatacttcctgtatctccatgtgggaggcatccctgtggagtttgcttagcacttggccatgctttgtttgaaaccttaaaagctcttaaaggaagttgccttatgttccctgatgagaagatgaagttggcaaaagaatggtgaaaggcagggatcttgatgagaggcccctgactatccctttagtgatcagcatcttcatttcccgtctcattccatgtcctggtggaatggctgcagaagatgagatccagagacagcggtagcacctgaaggaaacccttttcatcaacaactgcctgtgagaaaagctggaatgtcatctcagcagctttgatgaagaaaatggtgggagaggcccaagtcagtgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgcctccaacttagaggtatctacctctaaaatcattcttgtgattcctaggctgtcttctgtcttctatctgctgctgtacactgcctgctgtctctctgcttcttatgtgattggcattcagtagaacccaggtttctgagcacctcatgtagcagaatgagagtctcctctgctgccatactcatcagcttcccttatgtctcggttactcttcattctaccaccccaaggtggttctctccaacccccctcctcttagattgttctcacacagaggccatcatttcataacattgtgctgggccggaagaaccataaccaggtcccttcccataccaaagcagtaactattttggaaaagcctccttcatattgcagccattggacatgataatacatgtgatgtgctggaatttgttaagaatcatgtgaaaattaagcttctgccccatcgcactaaagttccagccctgagtccccatggttttctccctaggctaagatagagaggaagaacatgaaatatgcagaaagcattctcttaagcaaacgtgtataatttgcctaaattgtaattatttcctggaacagcatgcacctctaaactctacaggcacatcatagattccatcgtccagctgtataatgaaaacagagttctcagagaacaccggagactcccccgacttgcctgaatcaagtttctagaggtaagcggtgaaaatccacaatatgaagtcactctcagacgggtcccttctcttgtcacactccactgtagaaacaaaagaggacggggaagccagagctgctcaaaaccttataacccacaattgtcatagttattctcaacttacacagggctgctttctagacgcaccccctccaggcccccagactgccaggctccaggaataagtagctctgagaaatatagtttttcggtggaagccacactccactattgcaaattggagaagagaaggacaaacttaaaaggtgaaaagatttaagagaacaacatggtgaaaccccatctctactaaaaatacaaaaattagctaggcgtggtgacatgcacctgtagtcccagctactcaggaggctgaggcaggagaatcatttcaacctgggaggcggaggttgcagtgacccaagattgctccactgcactctagcctgggtgacagagcaagactccctctcaagaaaaaaagaagaaagaaagaaagaagaaagaaaacaattgttttagttgaatacattttgtcaagattaaatcaactttcccctagggtactgatagaataagcaatcataatttagattctaacttactggtctttgagaaattgtgaaaacaaaaaaggtgccataagccaaaaaaggagcaaaagtcctaattttcaagctgatgaaaataaagaatgaaaaatattgaaatcgtcatagttcatcttggtccttggcaaaatacaaatctattgattgaaaatataatatcctagctaccttattgtgcctagctcttaccactgaggagaaaaaccaaacgcaaacaaaagtatgttcaaattggcaaaaatgtttacaaacctgcaaaatctcttcagcctatccctcaaactccagacttggtatttactaagctctgctgtgtacaatacccaccttaatatccattcttgcacaagttctgttaggtataagccaagatcacatgggattttttttttttttttttttaccctctcatgcctatgtctgcttttgcttccaaagacccttctgagtaaggactgtcctcagactactggagtcatttagtcacaagcttgcctgaggctcagagctggcaatacctgggagtttatgtcaatcccacagcacccagcaaccttgcctgcaaattatttacccatgattgacaggtgcaggtgtatgaaagtccagctccttgacttgaggggtgcctttgtggtgaattagctttgggaaaagggaatccagaggccaactttgtaaaactccagatagataaatggaaagaaatctttgccttggaagtccagttgagaaagatagtgatttacttcagactgtggaaagagagactaaaatctttactttctcatgggaaagaagcctatggtgaaagagaaacaaagagaatggtgggaaatagggtgggtctactcagtagctttaaaccattctgtcatattataaagcctggtgaggttttaacacaagtgcctggactctacacctagagattctgatttaaatgcttccaggtgggtggaagccactagtagtcttaaaaagctcccaagtaattttcacatgtggctagagatgaaaaggaccatctatctattagaatgtcaagtcgccaacatagaagtgtcccaaatgtacagctacctcatagaaaaggcttaacaccacccattgatggaattttccttcctctcgccatggttttgtttgcatagcatggaaaaaagagaagagaaaaagaggtagatggatagattgaacctataatttgcctatgtagagcagtttctcaaacttatctgaccacaagatgcagtgagaaatatacaattctttgtgatcagtttttaaaaaatctttcattatgtgtaatccaaccttcctagtatttaaataaagcctgtagtagcaagcagtccactatattgatttcacaacccataacttgttcagaattgcaattagaaattttttttggccaggcttggtggcttgagcctgtaatcccagcactttgggaggatcacctgaggttgggagtttgagatcagcctgaccaacatggaggaaccccatctctactaaaaatacaaaaaaaaaaaaattacctgggtgtggtggtgcctgcctgtaatcacagctacttgggaggctgaggcagaattgcttgaaccctgggggtggaggttgtggtgagccaagattgcaccattgcactccagcctgggcaacaagagcgaaattgtttcaaaaaaaaaaagcaaaaagaaaagaaaaagaaagaaaaaaagaaaaaaatttttttcacttctgctcaacctttttatcaagcaaaatctcaaaagaacatttactgtaaaagaacattgacaacaaacatctttctgtgaatccttatttctgtcccagccaccatgacccaataatctctagagcctgttagtgttctccagattgaagccttccctctaactgctcctaaatctgtgatgtagtggaaaaagtttgaggccttgattctcatcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttaggagggttatttctctgcaaactatcctctctttcttatgacagctatttctgaatgtgcacatttgaggctaagcaaatcccttcctgggaggcgtgaaagacctttatttctctgcagaggagtattatggaaagtcagttgatgctgaggaggtggtagagacctagctaactcatctgcagcggctttgagcaaggcttttagaatcataaggtggctggggtcctgtgtcctacaccacaggccagctagttcatttcaggagactttcttttctatctattattactatcttcttctagactgtagttcactaccagagattatccacttagctgcactcagtttgcacctggcctgtatcaccacttagctctcactccagcctcagttaggtatcagcaagacctcaccaaagattattgtttcattgtatatgtgtgtgtgtttttgtttgtttcaggtaacaactgatgttggaactatgaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacacattctcttgcctatcatttttttttgtacaaatcacaattataaaactttcttgctccagctaaaagcaggaaactcagtcacaaatgtgttcactacatgtataccacagaatgatagcaaccagtctgattgcatcacttgattccaaaattaaatgttagcactcagtagtgaaactacatgtatctccaactctggaagccacaggcaagatactcctgtttcctgcagggaaacagatctataagcagggcagcagtctcacacatgtacactcctgtgaaatccaaggaaataatgatagtgacacagggcaggcaagccccaaaactggtttgtagcgtgggaaatttctcccagactgtagtctccttggctttgccaagaaaagaattcaaggataagccgctggtgagagaaagcaacttttattgaactggtgctacttcttgcagagcagggctaacctataggcagtgtgcccagagttggtgcctgtgggctactagctagttgtatttagagccacttttaattgcatgccaattaagaggtaggttattcagaactttctgggaaaggggcagggagtttccagaaccatataaagtaacttccaggccattgccaaggtgtgttgccatgacatttgtaaactggccatggtcccagtggtagtgtctttatgctcataagcagtgagggcaactagaggtcactttcatcatcatctgctggtttcagcaggcttctccactgcaccctgttttgaccagatcctgctctgttcaatggggttgggaatggaaaataagtccttctggtctcctacctcatttccccatcagagattatatactcctccttaatcttaaggggcttgcagaagggcggaggttcatcttctgtaactgcttcctgctgatgttatgggcatagaccctgcctagcactggagaggtaaaatccctggatacctgttctaaaaggctcaaaggtaggatgtctttatcttctgggtcagaagaggggatgggttgaaagccttgtgccagcatcatctttacatggaattattgtaatctggaagacacaaactttacaaggaggttaaacaagcaaagagcaaagattagtaataaaaagatatctattaaaggtcctaggaagggtaaaaaccaagtgtctgctggtagagattcctttactgaattccatcagcagggcaaagcagtaagagggaaaacattataattaggaataagagaaaaactttcatgctcatccacagcatcatgttattattgttatctgtgcatttgcaaaacaatagctttaagtcttccgggcgtttgcaaatataggtcacagcatcgtcctctgacatctgtgaggactcataacaatctttgagggccgggggcggtggctcacgcctgtaatcctaatactttgggagactgaggagggcggatcacgaggtcaggagatcgagaccatcctggctaacatggtgatatcccgtctctactgaaaatacaaaaaaaattagccaggagtggtggcgggcgcctgtagtcccagctactcgggagcctgaggcaggagaatggcgtgaacccgggaggcagagcttgcagtgagttgagatcgcgccactgcactccagcctggggacacagtgagactccatctgaaaaaaaaaaaaaggatctttgagcctgggcatagtggctcatgcctgtaatcccagcactttgggaggctgaggcaggcatttcacaaggtcaggagttcaagaccagcctggccaacatggtgaaacctcgtcgctactaaaaatacaaaaaaaaaaaaaaaaaaaattagtcaagcatggtggcacgtgcctgtaatcccagctactcaggaggctgaggcaggagaattgcttgaacccagaaggtggaggttgcagtgagccgagatcgagccattgcactccagcctgggtgacagagcaagatttcatctaaaaaaaaaaaaaacaaaattaactttgaagtttaacagcagtgggggtgcttaataatgcctgataggggccctttccattttggttgtaattgattcttgggggattcttctttctaagtttttagtaagactaagtatcctggttgaatgggcgagtcaatccttttccttgtgggaggaggttacgtttcacttccatatgattgaagggccttttgaacctggcctaagttgataacctatgtatctcttcaacaaacagaacgtctaaagttaaaaagggccttccgagctgctcaggcgacccagcctcccatcgctgctgctctagtgttcggttggcctgggccacactcaactgtagggagcccaggccaagaggcagcctgggccttctgcattgcgaggcgccgggcctcccgcagcgctccgctgacgggctgcgggcgggcaggcgggaggcctagtgtgggtcgcggtcgtggcccccgccgccggccctggccgccgcatcatgaacatagatgtggagttccacatccggcacaactatacctggaacaagttgccggccaatgtgagacagtcattaagtggagatggctcatcatggaggtcttcatccttgtcttcacaagtaggctgaagaggaggaaatacaggatgtattggtcttgctgttcagggtggtagaggaggaagaaaatcccagtcgtctttgaaattcacagagaatatgaaaagcaggttgtcctgtacagtatctgcaatcagttacgatacagaaataacttaaacatgtcaagaaagatgaatgcagatactatgaggaagtgctaaagtacagccaagatcatctcatgctgtacccttaccatctatcggatattatggtgaagggcttgagcataacaccattttcatattatactgggattatggagaatattatgaacagtgagaaaagttatgattcattgcccaattttactgctgctgactgtctaaggcttctcggcataggaagaaaccagtatattgatcttatgaatcagtgtagatcatcaaaaaaattcttcagaaggaaaacagcccatgatcttctaccaataaagccagtggaaattgccatagaggcgtagtgggtggtgcaggctggatatatcacataagatgacatcaagatacacactttgcctgagaaatgtgcctgagaaatcagcttcatcggcaactgatactgatacaaatagtcaagaagatccagctgactcagccagtgtaagcagcctgagtctgtctacaggacacacgaaacgcatcgcattcctgtttgactccagtcttactgccttcttaatgatgggatatctttcaccagttcagagcactggtgaaggagaagcacagaggtattttgatcatgcatttactctgagaaacacaatactgtttctgcatcataacaaagatctagttgtgcaaactgcacagccagaccaacccaattatggttttcctctggatctcttatactgtgaaagccttcttggtctggaccctggaactttcagcagagttttaaacaaaaactacacgctgcttgtttccatggctcccctcaccaatgaaatccggcccatcagcagctgcacccctcagcatattggaccagctatcccagaaatcagctctgtctggtttaaacggtacatttatcatatcactggacaaggaccaccatcccttttattgtccaaaggtacaagacctcaaaaactgccagatatatttcagagttatgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagagttcactcgtgtcaatatgggtgttcataaagcattgcagatactaaggaacagtggacttacaacatctctgcggatatgtcaccatgttgaatgtttccatccaacttgcaaatagaaaactcagtgatgcttctgatgagagaggaaaacctgatttggcttctggctcagatgtaaatgggagtacagagtcatttgaaatggtcattgaggaagcaactacagattcagcaacaaagcaaacctctggtgccacaacagaagcagattgggttcctctcgagctgtgctttggaattccactgttcagttccgaattaaactggaaagtttgtaggaaaattgcgctaaataacttatcaaaaaaaaatcattcatatttaaacatcttctcaaacgtcagcccattttctggcacaaacaaggaagcagttctcagtgatactatctgtccaaaatcaagtgcactcaaaccatcattttcttgtttgagtagcttgggctaccactcaaccaataaaacatcataatgttcttaattttctaaactgacaaggctatataataaaaggtacaaaatgtatataaccactcatcataggtaagtggcggattttctttcagtaaaggatttaaatactattatacttcaacagtcaagctagacttactttctaggtcttatattaatgttaattgagaactttcataattacttcctatataaagatgagaattatctgactttgaatttctatcatattagtatatactttaagtcataattgtgagtttgaaacctacatcaataatactatataagttctaaattaattgtaaaatattgtcaaaaaaattaaaatatttacatatcattatccccaccatatgcattggaaagagattattctttatgacatattctggtatatttcccgtgaatctctatctcttgtgaagtttcttcttatgcaatgcctggtcaccagggatctgtgaggttcatgatagaaatactaatagcagttactgaagtctgagctgacttgtgtgttgcagatgctgtgtgtcagagtgaagtattcttatacagtaaagtacatttacttacttaagtccaactgttccctagttttccaaggtcaaggaaaaaaatgagttataaaatggaaatggaaaaactctctctggttggctttgtggttattgcaccaatatctatttcttagaaattttcctgctagccaagtacagtggctcacacctgtaatccagagctttgggaagccaaggcaggaggatcccttaatcctaggacttccagacaagcctgggcaacacaggaagacatcatgtctacataaattaaaacatagccagtgtagcggcacacacctgtagtcccagctacttgggaggttgaggtgggatgatcatttgagcccaggaggtggaggctacaatgaggcaagattgtacttgatacggtttggctgtgtccctatccaaatctcatcttgaatgtccatgtgctgtgggagggaccctgtggaaggtaattgaatcatgggggcagttctttccggtgctgctttcgtgacagtgagtaactctcaagagatctgatagttattatatgggggagttttcctgcacaagcctctttgcctactgccacctacgtaagacgtgacttgctcctccttgccttccgccatgactgtgagtcttccctagccaggagttcaattaaacctctgtcttttgtaaattgccaagtctggggtggtctttatcagcagtgtgaaaacagactactacagtaaattggtaccagtagagttggggctgctgaaaagatacccaaaaatgtggaagcgactttgaaactgggtaacaggcagaggctggaacggtttggagggctcagaagaagacagaaaaatgtgagaaagtttgggacttcctagagactggttgaatggctttgaccaaaaacctgatagcaatatggacaataaagttgaggctaaggtggtcttagatggagatgagaaacttgtcggggactggagcgaaggtgactcttgttacgttttagcaaagagactggcagcattttgcccctgccctaaagatttgtggaactttaaacttcagagagatgatttagggtatctggtggaagaaatttctaagcagcaaagcattcgagatgtgacttgggtactgttaaaggcattcagttttataagggaagcagagcataaaagttcagaaaatttgctgcctgacaatgtgatagaaaagaaaaacccattttctgaggagaaattcaagctggctgcagaaatttgcataagtaactagaagccgcatgttaatccccaagacaatggggaaaatgtctccagggcatgtcaaaggtcttcacagcagcccctcccatcacaggcacagaagcctaggagaaaatggtttcatggtccaggcccagggtctccatgctgtgtgcagcctagggactccatgccctgcgtcccagccactccagccccgactaaaaggacccaaggtatagcttgggctgttgcttgagagggtggaagctccaagccttgacagcttccatctagtgttgagcctgcaggggcacagaagtcaagaactgaggtttggaaacctctgtctagattttagaggatgtatggaaatgcctggatgcccaggcaaaagtatgctgtagggggcagggccctcatggagaacctctgctagggcagtgcggaagggaaatgtggggtcagagcccccacacagagtccttactggggcaccacctagtggagttgtgagaagtgggccactgtcctccagaccccagaatggtagatccactgacagcttgcaccatgtgcctggaaaagctgcagacactaaacagcagcctgtgaaagcagccaggaggggggctacaccctgcaaagtcacaggggtggagctgcccaagaccatgggaacccacctcttgcatcagtgtaacctggatgtgagacatggagtcaaaggagatcattttggagctttcagatttaactgtcctgctggattttggacttgcagggggcctatagcccctttgttttggccaatgtctcccatttggaatgactgtatttattcaacgcctgtacctgcaatgcatctaggaagtaactaacttgcttttgattttaaaggctcacaggtggaagggactttccatgtcttgaatgagactttggactggacttttgagttaatgctgaaatgagttacgactttgggggactgttgggaagacatgattggttttgaaatgtgaggacatgagatttgggaggggcccagggcagaatggtttggctgtgtccctacccaaatctcatcttgaatttccatgtgttgggggagggacccagtgggaagtaattgaatcatgcgggcaggtctttcccatgctgttcttgtgacagtaagtctcaagaggggagttttgctgcacaagctctctttgcctgctgccatccatgtaagacgtgacttgctcctccctgccttctgccatggttatgaggcttccccagccacatggaactgtaagtccaattaaacctatttcttttgtaaattgcccagtcatgggtatgtcgttatcagcagcataaaaacagactaagacagtactccagcttgggctacagaaagagaccctatctctataaaaataaaataaaaaatgttcctgctattcaatactacatcgtatcttcttcaggatagttcatttgggaatcgctaagtttacccctgactctagggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtccttgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatgtcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaggagcttacagtgaagtagtctcaagcaattgctttctttttttttttcttttttttcttttattattatactttaagttttagggtacatgtgcacattgtgcaggttagttacatatgtatacatgtgccatgctggtgcgttgcacccactaactcgtcatctagcattaggtatatctcccaatgctctgcctcccccctccccccaccccacaacagtccccagagtgtgatgttccccttcctgtgtccatgtgatctcattgttcaattcccacctatgagtgagaatatgtggtgtttggttttttgttcctgcgatagtttactgagaatgatgatttccaatttcatccacgtccctacaaaggacatgaactcatcattttttatggctgcatagtattccatggggtatatgtgccacattttcttaatccagtctatcattgttggacatttgggttggttccaagtctttgcttattgtgaatagtgccgcaataaacatacgtgtgcatgtgtctttacagcagcatgatttatagtcctttgggtatatacttctcaaaagaagacatttatgcagccaaaaaacacatgaaaaaatgctcatcatcactggccatcagagaaatgcaaatcaaaaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcggggatctagaactagaaataccatttgagccagccatcccattactgggtatatacccaaaggactataaagcaactgctttctaagtgggatggctgaagcaagagaccttaaatcacttgaccgtcttcacaaaacagaactgaagcagaaccagaagtcccctgatagcctttcagggacaccacctacaaatacaccgtaatccctcatactccacatgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgccaagactagacttaggcgttttatcctttttatgacattatgtatgttgaagagaatatatgaatacattttatatatatgaatatatataaaaccttcattatcacattattctcaatccagcattttctcagcccctgattttcatgttagttcagcattcttacatctttacagattttcatctaagactacatttctactgttttatataatcagcccccctaagatcaacatgtccacattttttggcaaagacaaagcctactgatttcaggatcattcttttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaccagctaaaaagtcgcttaagctaagaaaccttcaccagcctcatgggaaattgtgtacagttttctactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactataatattaaaattctgcatgtggcataaaacatattttaatggagaaggtaatgtgtagggagtttatttctgtttgctattagaacttatgtttattcttggttaaaaaaactgcactgattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttctttcaaatttaattaatcctcaatgtccttgtaaaatagccaaagggaaaatgtatttacattactctaaatattgatgcaatctacaaaaagggttaaacaacttcctcaaagtaaataaaacgttcacaatccagctaggataaaaggatttaaatcatttcctaggtagagggctttcaattagagcccctgctgcattaaccatgggaactcatttcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacctctggtccacagctaagcaatcagtaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaaaggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtaaatattagcacatgaactgaaaatattaagtgattataaaaaagtccaaataaattcattaaaatttagcttggcaaaatgttagtttcatgttcttggtagaagtccttttatatttatattcaaatgaaatgaacaatttacaagcaaaggaaatggcatcaaatatttgacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgtagtcaaacctgtaagtcaaaggatatgaaataatagtaactacacattaagcacagaagaaaatgaaacaaacaaaaaggttttaaaccaaccaaacatatgtcttattttggatgttctatatgttcttacattctctcaggtcttttgtgtcgttatgaacacaattctaacaagcttgattattttatttccattcacatattacaggcaacaagctgaaaaagtagaacagggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagtctcctctacaacttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatctaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcaaacaatacaagaaaagccagtagaaattgccaaatgtatcagaatacacacaggctttctaaggatatggcccaagaggaaggctctagagcccaccctgaaacaggatttttgacttcacagagaaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgacttctccataggcagaaaactagcgtagttttttttattagaaattgttattcaataatagtacatgttacaaataaataccattttaaactgaaaaaattgtagactttcaaatcagttagggtggtcaccctaaaaaagggcatttttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatatacatagagagatagtatgtagtatgaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcctgtgtaatgttccggggtttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggaaaagaaagtcaacaaaggaagttcatatgaaatcaaactagtaatatgattacaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgcttttcagctggagggactaacttttttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaataaatgtgataccaataatcaagaattcactcagttaagattttgcccactgagttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcatgtgttacctaaagtggcatgtggttccctaaagcttaataactgacattgccttaaaaaaggggtttgcttcccaactaatgtggaaaaagtctgaaaaatgattttaaatctttcactaaatttctcatttggtcacgtggaggaaaatgatttcaccaaatagatactcttattaattttttaatgtaatttatcaaagaaatgaaatatttagataaattccaggtttcccccaccatgagcttctccgaaagtatactccatcacagactgctcactaagaagctctactgcagtcaaagtgaccgaatttaaggggacataatgactacttctgctacacagaaacattatccatctctaacacttccctatgagacggaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtgtgaaatgccaaatgccagttaaccaaagctttctttgtcataaagcaacttctataaaaattgctgaaaataaattcttcatggctcaatgtgaatcagtaatttccatttctattacactgttgtttacccaaaaactatttttaatgactaagactcagagtttgccaaagtgttttccacaaaacaactgttttgagatactccagatctgtaatcaagtaagtctgaaaaaccccaaatacctcactcacctcttggatatgcataaagcacactaatatataacgttctaaaaagccaatcattaaaactgttttatattgtttaagcatttcctagacatatttggctacaaatctaacatctaattaaacagtttgggaaatgccatcacataatgtaggaatattactagtcatttaagaaactagaaaatatttactatattctaggcagttggctagcagttggagttctagtctctaaacaaaatactgacttatttctgtgacttttttcttttaatgtgacatcactcttttaagcagctctgtgcttcacaattttttttttcctggtttgttttccacttttgtctgtactttattccttcacagatgtgaaaggctaacaaatgtaaactagttatattaatcagcctctgcctcagttctacacttcaaatacagtatatactctatcaacaattcttggataataacaacctgtacttgtttttcaaacaataaaacaggccgggcaccgtggctggctcacgcccataatcccaacactttgggaggccgaggcgggcggattacctgaggccaatatggtgaattctcctctcgactcaaaatacaaaataattagctggccgtggtggtgtgtgcctgtaattccagttacttgagagactgagaggagagaatcgcttgaacccggggggcagaggttgcagtgagccaagattgcaccactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaagatttcaatagatgtctccctctaaaattaatattggatgatttgtcatcttccatttaataccaaaagggtatcagccacaaactgaaatatcactcatatgcaaataaataacattcaagacttttatcgttgtggttattaatcttgtaatggatggacataaatctatttacattctcatcctatcctcaaatttcactattctctcctctcattcttactttgttctactcatattctcactctatcctcctatgcataaaatattatgtattctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcacgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatggataagaaactcaaaatcaagaattttaagacactgggttaaggtgattgagttaagtcaaagccaacagggcatgggctaaatattgacatgggatgggatgaagaggccaacaatgtttcaaagtagaggttgccagagcttcaggaaccagaagaggaagacttgaggtgaaatctgaaactgcaatccccatgcctggctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggggaacatgaaagatagaatttcagaaatttagagaatgaaaaaggaaagattacaaggcaataagttgattaaaatactaaaataaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcagacactacctttgccaaccagcagattttcagtactgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcactcaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctgactaactcattcagctcccttcatactccctccccacagccacctcagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaatgctgaatggcttcaaaataactgcatatgccaagatttctggagtgggcacgtttgatcttctttcataatgaaaactgacaaacctttttagggggatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccgggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgttacactggattcatatgaaattccactgcaagtgacatcaccagattggggaccctgaagtgtttgagtatcttctccacatctggtcatttaggctaagaaattccttcttgtctaccaggtcttttagcattcattgtgtaagtcattcaacacctacttactgagaaggaatactgggctagacagtgtgctagggcctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacataggcaggcaactcacatcctgccaaatattaaatttctaattttattataatttctaataaaacattagatttattattatacagagtcatactcctcgattgggaaactctcaactcaataaacattctttagtctcatgtcttttctaaaggaaagaaattaatgttatattcttgggtgaaaaaaaatgtgaggtctcaaaagagtataatacaatttggggatgcatatatattttacatgtatatagacacataaaaatctaaaagaataaattttaatatgttaacagaagacagaagtcatgtattttttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttccaaactgtgtacaattgaagcttctgctttatagctcttagcacacctctcaaataagaaggcagtactgggaaggctctgaacctgtggcagaaccaccgatagctgtggagctattccaaggagtctgggaatcaggggaattatcaagatcattgttagaataaattaatcttactgtatatatagcagaagttttcaagcatatgtaaatgctactaataaccaaataattacaccttgtttttctttaaactgtaactctcaagtatgtctctacataattttttgatggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatgtagaacaaaattatcgtgttttttttaatagtaacatgtaagatcaatctttgtctttaaaataccgtgtatctcattcttggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacagcaagattattttaagagtctgactgaaatgtcaggatgagaaatagattaataaatattggcttctaatgtcggtaatgaaaacaaacacgttattttcagaaaataaaaggtcttcaccattaggtacaaatcataaagggattatctacggttactacactgtaacaactttttacatattgtattatagaacaagcttttgagaagacaaagcaacacatcagcagtttaaccaattgtctttctcttttaacaggctggtctacactagattacatataaaaggcccaggtattacttgtgttcgatcttagccaaatggctgagaaacatccaggtacatttaaatcagtgacaaaagaaaacattatcccttagtaaaattacataaaataggaaacatctcttactttaagagcaaccatggtacttgttcctatggtgaaaactgatgttatctcgattagttaattattcatcccaacacctggtcttgctcccttttccacctctagctatgttaacactagagttcagtaattagctgataaagaatcttaactgcagtatctaacagatcttagtgattaagcatatgacttaccctttgtacagataagtaaactgaggcccaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaggatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcaatgtgccaattctgggtcttaggcatattgtatatactggaatgatattcactttaattaaatttgttttgagaagtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcaaaattggatttgggttcgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaatgtacagagaattggcaggctgcatgtttatgtgaaccttcagaaaacgtggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagcaatctagtactgtagcagaaccgtttcaacatgaagagttctgctcatcgcctgtggcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggcgctccatttggtggagtcaggggaggcctggccgggcgggtggcgagggctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttacgagcgcagcgcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaggaggaggaggaggtggaggagaagggggaggtcggctttccatttccagatgtgacctcccagctgctgctcgccgctgctggattccaatttcctccccttctggcgatggattggtgatgaaaccgagtctcactttctccttcccccgcccggaccaaccgccgtggggggccgagggtgccggggacggccggagagcgatcaccggctgggcggcgggagccgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccatcacttttatgaattcgactccactttctaaaggaattatgagtcttgtggcaaacacaaaccggagtggccgggagggggaaaaggggggaaaagaaaatctttaaaaattaaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttattgatcttttctccgctgagaaggctcccaccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaacgcctttatctttcaggaaagaaattacaaaatagtttcattgtccagtcatattcactatgagttataagaggaaacattctatctagaactagaaataccatttgacccagccatcccattactgggtaggtacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggagactgttgtgggttggggggaggggggaaggatatcactgggagatatacctaatgctagatgacgagttagtgggtgcagcgcaccagcatggcacatgtatacatatgtaactaacctgcacaatgtgcacatgtaccctaaaacttaaagtataataataataaattttaaaaagaacaaaacatcacattgtacgacataaaaaaaaaaaagttggattttgcaaggaagatagacatctgactaaagtttggccaagcaaggaatctttgttagtactacttcttgtttaaggaaagaagagacattcatctttccttcaaacagtataagtctcttttcttgtttgatcaccttttattcattaaggaccagttgaatcatctgttgggacttggtagcagaggatatttcctggatagtgtgagctatcaggcctttaatgtgggaagtttagtttctataaaaataaaattaaaaaagattaatagttggaacgaactataaagacagtttctgagcccagagggcagctgatcaataagatttctagatgctgggcttttaatatcttcagctggagtgagaagaggcattggattagtttgcagtttgaatgccataaagatgggccacacacaagctgttgtggtaatttttctgaagcttatgtcaagtcatccagtttcagtttgaaggacttcaagaaaagaaaagtttataattttagtgattccaagctagaatagcaggaaaaaaatgaaatattaatttggagtattgtagctaaatattgtagtaaactagaaaaattgaggatctattgcagattgcaggcagataataaaacctcagaaaaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactgtttatgtacacaagtgcagttaagagtagtgattgaccatttaggctcttttaaaggttgcgtttgtcagataagaaatctcagattaaactttttgtttttgtttttttagacagagtctccctctgtcactcaggctggagtgcagtggtgcgatcttggctcactgcaacctccgcctcctgggttcaagcgattcttctgctcagcttcccgagtagctgggattataggtgcgtgccactatgcctggctcattttttgtatttttagtagagacagggctttcaccatattggtcaggctggtcttgaactcctgaccttgtcatccacctgacttggcctcccaaagtgctgggattacaggcgtgagccactgtctccagtcagattaaacttttaaaagccacttgaggctgggatacaagcccaaaacttgtcattagtctgcacctgttacatttatagattcagataaatttctctcttattgaggtccctaaaatatcccaaggtttccacacctgccaaacagtgacattctttatttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatactttgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaagtcattttaaaaattattctcatcagttcattcagtaccacgtaattaaatcttgttttgcttgatcttgggttagtagttacatgaacccgtcagttttattagagttctggaaattcttaccagtccaattgtatgatgttaaagttgttcagaaacctgtattccagaatactcataagagtattttccataaatctccttgaagaagaagccattttggactgtagctaatttcaaatgcttttagagaacaagtaaattaaaacaatgactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaagaaatattctttgtggctttctgagggtccaatatggagaatcctaagttaatttgaggtcaaaaagacttaacttagaatgtgattttgggaagattgtcaaaaatgtcaaaaagtttaaaacatttaaaacaaatattaccatagttatctatttaataaaagctccattaaaagattttaaaggcaaattcagattacatagttgtgaacaagaacttagctcctttaatattgagaagactcacttttcttaagtaaccaaaacctaataaaacaacatgaaactcaagaaattatcttgacgaaacagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagatatgttttcttatttacatttgcaacagacatacaccagacaattaagcaatttacttttactacatatcctattcttaggttgaatttatggttttatggccttaaacatctaacagtaacaacacaaacttgtctaatcagcaaagccaggtaaaataagtgtatgctgacagttctgaaaatgtttctatttttattttaccaatattttttaaactagtttttatttactaaggaatatcccagattatgtgaacctaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagactgatgtaaccagatcttatgacttttcatttaaaaaattttaaccaggccaggtgcagtggctcatgcccataatcccagcactttgggaggctgaggcgggtggatcacctgaggtcaggagttcgagaccagcctggccaacatggcataaccccgtctctactaaaaatacaaaaattagctgggcgtggggcatcgtggcgcccggctgaggcacaagaagcacttgaacccaggaggtggaggttgcagtgagccgagattgccccgctgcactccagcctgagcaatgaagtgagactctgtctcaaaaaaaaaaaaaaaaaagtttttaaccatgaggcagtaaaacagagtaatacaaaaatacaaactcactggtttatctccaccttatattgttatccaaattgtgtttctggtgagaaagggataagttgagttgacctacataacaaaggctaaatctttttaccaatatttgtggaggaggttttttaagattttttttttttttactttatcagtttccaaatagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagctcagggaatcagggaataacccctcactcagaaaaagagagccagaaagaagagacttctagtctagggactcagagaatagatcactcagaacaagaagcccacaggaagaccttcctgcccagaggattcctttcaaaagaagcctgggactctaccccagcttcagagagaatattcatcccttaagattcaaaatctgtccatagccatcaacgggcttttgtgtggagcaatggctcagaaatctgattcaccaatggatccctaatcagtcagaaatgacaacaaagacttcaaaggcatgcatttagggtcctgagtgagaggcccaggatccagtgatgaatctgtttcaacaccataattgttaaagaaaaaattattcagtgatacttcaaatgcacagtaaagaagactttattcaggaccattaccatagatataggaaccactgcaatacagtcttggagctggggagagagatgggcttaactctgaatacagcacggggaagtgggaatttatagaccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgagggggtctttggtaaacttggcagtgttctttgctaatgctggattttgtgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgtcttaaccaaaatccagccattctagaaagacaccagaaggctttctgcagcatctaaaatttccccacattctaggcccaaatccttttcctttccctgttgcttttagatccacattgtgtaaccctcatctagaaacctcagtttcttggagtcattttttttttttgggacggagtttccgctcttgttgcccaggctggagtgcagtggcacgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagatgatccacctgcctcagcctcccaaagtgctgggattataggcatgagccactgagccaggccattctgtctttttatataatataacttgtacttttatgtagtaagttatcacaatggtgtcagacactctgaggaagagtattttactgtatcattcccattacccaatcaggaagtcttaacaggcagattttaacaaaaatataagacacaactgtgcctagcttttctcacatacttcctacctcacacttcacacatttctttttctcagcacccactcttaagtaataatttatttcccctgaatattatttaccttctgtgggctaccttacatatcatctgaaagcatgatcaaaacagttatatttgtgaataattttattttggtttatttcttagcagaaggaggagttaatagtaacatttgtaggccgggcacagtggctcaagcctgtaatcccaacactttgggaggccgaggcttgcggatcatgaggtcaggagatcgagaccatcctggataacacggtgaaactctgtctctactaaaatacaaaaaaattagccgggcatggtggcgggcacctgtagtcccagctactcgggaggctgaggcaagagaatggcgtgaacccaggaggtggagcttgcagtgagccgagatcgcgccactggactccagcctgggagacagagcgagactccatctcaaaaaaaaaaaaaaaaaaaagtaacatttgtaatctcccagagattgccaaggaaaacattctcctggctgaatttatgtagagttcatcatctaagcataaaatattttataaaggaatgggccaatcaaataactgctatgcggttgacactataaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacagaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatatctccatagatgtctggaaacagcttaattctgttaactgctgcccattgaattatgcttaatttggttgtagaatttcatgtcatctgttattctccctcacaacttgggagacgttattcctgtattgtctgttctcgttgatgaagagaagtctgtgataaagtaattgtccttcctttgtaggtaatctgccttccatctctggttgatttgaaaatattgtattagtctttagtatcttgcattttactgtggtatgtctacatatggatttatacttactgagtttgctcagagcttggagtatttcctcagtcttaaaggccctagttgtgaaaatgttactacagaaaaactttatttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctctctcaatatatatcccaattttcagtctttagttctaaatctttcagcaacctggactatcatggccccagtgtaatgcttggctttgtacctcatgagggaagaaattttttttttaatcttaagttctaggttacgtgtgcaccacatgcaggtttgttacataggtatacatgtgccatgttggtttgctgtacccatcaacttgtcatttacattaggtatttctcctaatgctatctgtcccccagccccccaccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattctaactggcatgcgatggtatctcattgtggttttgatttgcatttctctgatgaccagcgatgatgagcattttttatgtgtctgttggctgcataaatgtcttcttttgagaagtgtctgttcatattatttgcccactttttgatggggttgtttttttcttgtaaatttgttgaagttctctgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctagtcatgaagtctttgcccatgcctatgtcttgaatggtattgcctaggttttcttctagggttttttatggtgttaggtcttacatttaagtctttaatccatcttgagttgatttttgtatatggtgtaaggaagggatccagtttcagctttctacatatggctagccagttttcccagcaccatttattaaataggggatcctttgagggaagaaaattatttctaatattttaatccagctatgtatgtaaaaagaagtctttttcatattttatctgttatttctgtatgattggagtatgagtcaaaacatctcaatataaataaaaagttacatttcagtaatttttttttctaaaattacaaaacactagtggtcaaaaacactactatttccaattctctttcctttgttaacattactttttgtacttatgagagaagagtttgcaatccaaaaagagcaggaaggaagagagattagagattttttctcctgcttgctctatacatatgagatatttatatatctatatatcaacacttgacctttgaataacactggtttaaactgtgtgagtccacttataggtggattttttcagccaaatacagattgaaaatacagtatttgtgggaagtgaaacccacatatgtggagggccaacttttcatatgcgagctctgcaaggttgactgtaggacctgagtatgtgcagacttcggtatatgcagggctcctgaatccaataccccactaatactgagggatgactgtatatgtctctatctatctactctatcatatatatatatacacacacacacacacacaaatatgtgtgtatatatatatgtatgtgtgtatatatatatgtgtatatatatatacttcctatattactttgctagggttgttataacaattactgcagactggatgagttaaacaagagaaatttattttctcacagttctggaggctagaagtgtgaggtcaaggcatcagatgtgttaattttattctgaaatttctctccttgccttttagatagtcattttctcatcttgtcttctcatggacttttttctgtgcacatgtttgtctgtacctaaatttcctcttcaaataaggacaccagtgatattggattaggacccagacatgtgacctcattttacattagttacctcttaaaagtctctatctccaaatatagtcaccttctgatatactgggatggcagggggcagggtacagcatattaatttggggaaaggccacaattcagcctataacatatgcaatatattcttctctgatctatactatataacttttatatataatacatatataatttaatatacattttaaccccttgattaattttgtcactgcagagaaaacaagaattaaagaaaagcttcaggtgatactgtttttgaatgagtaagaattgagcctgcccttaacacaagaatgaagtagaaataaactgacttagggaacagcataaaaaagttctcttatgagtcaagatttcagtgtgatgtcatcattttttccagggattaaatattagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctttctgtaatatcttgtttccaaatgaggctcacattgaattttctcttgttagaaatataactggcaagaccaatcaaaaccattcattccattcagttgcctgtgaacaagcttgatttgctttgttattaatacagcttcttgtgggttaagtagaaagctcttttgtaaatatccctcagtttaagtatatatagtttacatttccaggtaaactgtaaattctctgagaaaggcccagcatggtggttcaagcctataatcccagctctttgggagtctgagatgggtggatcactggaggtcaggagtttgagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccaacctgggtgacaagctggactctgtctcaaaaaaaaaaaaaaaaattctgtgaaaagatctgtgatttccattctcctttatagtaattgttaagcactcacaattagatggttataacaactatcaaagaaaaacaattattttaataaatatttttcatcattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagagagggataataaatagaacttatctcataaaattactgtgagaattataagtgattatgaagttgattaaatttccccagtgcttcatacaaagaaaggactcaaaggatatgctagttcatagtaggggcatagaagaagatatcccttctctcctgggatatagggtatacataactgtccactataaaattgaagataggctagagaaaagctaaaaatgaagaatctaataactctttagccaagagaaaatgaaacatgagggaaagggagaagttccaaatgaggtccacattagtcgtgggccactgaatggtggtgccattcaggcagaggaaacccagaaggaggagtcattctgtagttagagggcacttaatgagataatattagagataactgaggttgagttgttggtacgtatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacaaaaaggacacattttcaagaaagacattgtcaatagtttaaatgtcacaaaatagtagagtataatgcatttaaaaaaaacaaaatctattgcttttgttaattaaataactagtaacctcggctgcagcagtttcagtagagtgaggagagttgacaccaaactgcaccagtggagtgaaaataagtgggaagaaagagtgaggaagtggaggacagtctttttttttttttttaataaaaatattttcccaaactgtcttttctggaacttccaacatgtctgcttaagagcttgtcttagttgaattcattcgaacttcttgaacctaattagtttctttttgctgtttttttttttttttttttttttttttttgagatggatccttgctctatcgcccaggctggagttcaatggtgcaatttcggctcactgcaacctcctcctcctgggttcaagcagttctcctgccgcagcccaattagttttaaagacgctgcatatattggcagggaaaacctagaacacaaagtcaaacttccaattatctcccttcagtgctcaaatcaagagttcatttgttgcaaggaatggggatctggactccagggagaagaatagagttttaggaggaaagttctcctaaaactaaatggaaggagggttctttgagataccaaggatttgcaggactttatttacaatgaaatgttagtttcagacagcccaggaggaataggtctattaaaggaaagcaagagtagttggcgtaaggaaacaatttgcactggagcctgagagtgagtatagtaatgaccacatgagagacccatttgactcaagtacttcaaagcattgccagtgttagtctttgctccataatcaagtggggaaaaagtgaaatgtctttgaagagcatttcctgtaggtggcctttgaggaggtcctgaaaattccaaacctgcaagtattaatggcaaagaataaaaatttgtttatataaaatacttttaaaaatctttctaaatagcaagacattatatattatcattgttaaaagataaacgaattgagaaatatcattagaattatatgcagcagataaaatggtcacttttttttttgagacagagtctcgctctgtcaccaggctggagcacagtggcgtgatcttggctcattacaacctccaactccctggttcaagtgattcttctgcctcagcctcccgagtagctgggattacaggcacgtgccaccaccccagccaatttttgtatttttagcagagacatggtttcactatgttgggcaggatggtcttgatctcctgaccttgtgatccacccgccttggcctcccaaagtgttgggattacaggcgtgagccactgcgtccagccaaaaggtcactttttaaacttaaaaattattaagaaaacagtgaaaacttaatgtttaaaagagtagaagatagggaaaattattacacagaaaaagataaacaacagagaaagataaattgccagtgaatatgtaaaaagttgctcagcaccagtggtagttcaaatccaaatagcactgagttagcatttgttaactaataaattggcaaaaattatattttgataaaacccagtgttgttgacatctcaagaaaaagggctatgctcacacagccttggagcatgtgcacattgatgattttgttggcataaaaattagtggtttctattaaaatcagcagtgtaattcacaatcgctaagacatggaatcaacctaggtgcccatcagctgtggattggataaagaaaatatggtacatatatgtcatggaatactttgcagccataaaaaagaataaaatcatgtcctttacagcaacatggatgcaactcgatgccgttatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaaaaattactatgcctagtacctgagtgatcagatcaatcatgcagcaaacctcagcattatacaacatacccatgtaacaaacttgcacatgtacccactgtatctaaaatcaaaagttgaaattataaaaaataaaaaagaaaatcaacaatgtgtatttctctcacacagccatcacgatgatgtatttggaataatatatgcataaggatgttcattgcagtgttgtctgcaagggcaaagtgaaaacaatctgaataaccatcaatatgacacagagtaagtaattattggtacgtctctacaatgcctcatgcagtcaccactgacagcatgggaaagagagacatctattatgaaaagaccactaagacatatgattacatgataagtgcaaggttcatgaataaatagtatgtatactagtatagcatacttctttctaagaaagaaaccataacacatacacgaatggacaagaaattattaacaatagctaactttggtgataagactgtaggttgtaaaaagccagactttcatttctcattttaaacccaatgaattatttaaatctaaccctactgcattcattatctttataataaaataaatatgtataacaatgaaacatactttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactactaactcttctctttggcagatcaaatgcttcttcttaaaaaaattgattttttaaaatgtatttcataggatttttgttctctctctccctctttttgtgcatatgtgtgtgtgtctgattagtctttattatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctctagttcaaagatgcttccaatagttgacatggccattcattccttaaaaccagctatttttctttcgaattactttacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaaagaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataactttgagttgagagccaaattttttgaaggtaaaccatctccctgttttaaagtagtgtttaaaattataaaaatattaatacatctgtaacataaaatatttagatataaatactacaagtgcaaatgaatttttttttctacttctgcattcaacttttctcttctccctttagggaaaacacttttgtgtaaaggcctccaaaatatatgtagagtcgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacaccaagatctactcctctgattttgttctagcattatcttaatggaaatgtttactgaaatggaaatacatgtagtggacatcgtggtggtgtctcaagcattcagtgttccctgctctcacacactcctagccaaataatgaatttctcagcttcacaatgtttaagtgacatgagtcccatgcccaattcttggtcattgtaattggtgcatgaaggaacatgtgccttctgctaatcaaatcagaatgaagtacaactttttcattccatgattgaagagggaaatgccttctttccaaatgcagcagaggaagcacgaggtactaggattggaagttgtctactcatgacatgatattttaagccatagaataaaactgagacctaatgtcttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgccctcacatggtggaaggggctaggaagttctctaaggtctcttttataagggcactaatcccattcatgagggctctgtcctcatgacctaatcaccccctgaagacccactgccaaatatcatcacactagggattagatttaaacatacaaattttggggggatacaaacattcaatctatatcacttaaggtagagtgaagaaacagggaggacaagaagcatttattttgtgtcattattaaacttctgcattaaactatcttgagcctatactattgttcaaaatctctttattatacaagccattttgaattttgattgtttgcaaccaaaattaacctaataaattaaaatgtactataatgttacatcataatttgtctgtactagtagtatttgctagaacgtttaggggaatacttgcttgttaactttttagtaaatataacactccatgttcaaatacatttggaaaatactgagcatttcacacttttagagactcaaaacaggcagcacatttttaaaaaataaaaataaaaccaaatagcattgcatttggagaatggtataaaaaaagagaatttgataaactggagttatcagaactcagtggatactatgtgttagacattattataagccattaaacattttacaagcttgatatctgagttaaaaattaataacccaaagacacattggaagagaaaagttgacatatttttattatattaatgacctaaaaatatcatagcaactaacatcattatagtcaacaagtgaatgaacgtaaataatattaaataactattagaaagtctctctgattaagcatggaaataaataggcagtgcttttgaccaataaatggaggagttacaatactttccaatacaaaacaaaaagattctaaatgtaaaggtattaggcccaaaatatgttagtcaattcatgacagcagaaattcagcaggtcatatttttgaggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggactgaggcaaaaaccctgaattataccaatattatcttttttttttttgagacaggatcttgctctgttacccaggctggagtgcagtggtgcaatcatagttcactgcaaccgcgacctcctaggctcaagggatcctcccacctcagcctcttgagtatctgggactacagaacctcatcaccaaaacacccatctaatttatttattttttgtaaagatgaggtctcactttgttgctcaggctgacaagtattatcttaatgttatagaaaaaaagtaattctggccatatataggtattattctttgcagtggaatatcatttcagaaacttgtgccaaacataaaattagttttctagtagtaaaaagtaattaaactctttaaattattattacccctagtatactggggaatgggtgtgtgttccaaatgaaaaaacttgggatgtctaatgagatgctgttttctgtcgtagaaaatctatgtaaaatgttttttctcacgtgtacactgttgatatttgagacagcacatgttaacacttcaagaagtaaaataaatgtgttgattatatccacagttttcatatttattaactacatatttcgtttttaatgtaatgcctattgaaaaacctgtaaatagttgtttcttaaaattgacaaatactgcctaagatttttctgtatattttcatatttcaattttcctgtgaggttagaatgaacattttagctaagacatttgtgcctccaaatcctaaacctttcagaatgttagtttattatttggtttttacctaaattattttctgcttattcaagaaccttaggtctatccagttacgtttttatttttttatttttatttttttattttgaaacaaagtctcgctctgttgccaaagctggagtgcattggcatgatctgggctcactacaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcatgagccaccatacctggctgtatccagttacatttttaagaccagccaggcttaatatatatttggtcttttgctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagaaagccagatcaaagctaggcagccaggaaatgtaccccaaaccatgctgtagaactcatccagggaggaaaccactgtcaccaccagtaagaaataacaccgaagatgcagggagcaacaattgcagcaattgctcaatcctaggctaactgcaaagccaccagcaccactcccacttgttcgctttgcaacagatattgtagcagctgctacatggcctccaccagaaacaagagaaagcataactgaatctgcttctttttttattaattccgaagtggaaattcagcactggcaaacagattggcaaaacctaagtcatatgcttgtaccctagctgcaaaggaggctgagaaagcaagcatttggcattttagcttctaaagcaggaggtggtttcttgttttcgtcaaaactgagaggctgaggaattcctcaaacacagcaacaaacatcaaataataaatattcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacgaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtcaaggctctcctttctgcaagtggccagcaggtcactattggcatctatggccatgtgccctcagctaacacctctgctagtcagggttttgccttgtgagatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagggttcactctttgtgtggtacaggtctaggagttttgcaaaacgcataatgtcatgtacccatcattacattattaccaacgtattttcaatcccctaaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccatggcttccacaatattcacacgttctttcaccttgccaaaggccacatgcttgccatccaaccactcagtcttggcagcacagatgaaaaactgggaaccatttgtgttgggtccagcatttgccatggacaagatgccagaacctgtatgctttcggatgaggttctcatcatcaaatttctccccatagatggacttgtcaccagtgccattatggcgtgtgaagtcaccaccctgacacataaaccctggaataattctgtgaaagcaggaacccttataacgaaatcctttctctccagtgctcagagcacgaaagttttccgctgtctttagaatcttgtctgcaaacagtttgatggagatgcggcccaagggcttgccgtcgacggtgatgtcaaaaaagacgacggagttgaccatggctgatagtacagggctcacagtgatggtggcatctgcaaagataaccactgatctttttactgtctttatagtttggccttttccagaatgtcgtatagttgaaatcacagtatgtacccttttcagactggcttctttcacttagcaaaatgtctttgttttttctgtatctttttgtggcttgatagttttttccttttagcactgaataatattccactgtaggaatataccacagtttgcttatgtagtcacctattgaaggatatcttggttgcttccaagttgtggcagtcttcattaatttctttctttctttctttctttcttcttctttttttttttttttttttttttttgagacagactcttgctctgtcacccaggctggagtgaagtggcacaatctcagctcattgcaacctccgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgcaacaatgtagccgcattttaaattttaaatttttgacagtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacgttcataacaaatatcaaagattgttgtattttttatatgggagacaccagacaagcttatacttagttactagttcagaggatacaccaccacatcgtctagcatgagtacaaccttataagccattgtctccagctggcactgtgattgagtctttaataaaatattcaccattctataataataataattttggttggtgataggataaatggtggaccaggtgagtccaatgaatatctactcatttgttatacaacaagttcttttaatagaaggatgtagaacaggatattatggcagtatatataaggcattcaatgtacccatggagagtggcgatcagagaaaaatgatgtcaggtaaagcaaatgtaattcaaggataaaggtagattccatttacaaaattccttgttgcctttatcatagaggagctccagtaaaatcaacaagtctgacaaaaggtgactggtttattcacccaggatatgttattgtgtgcttagccttggactttgttgcttgtgtgttggacgcctaatagtcttgacagctaaataggcttttgtaagcgagagtggtaaagtccaacatgttgctaaacctatgtgtattctctactgctaccaccaatgttgctgtttattagccttctgagcaagcaatgtagtgcctggtgaaagagattgtttcataccttcatatctatttgataaccttcctgatgatagtttggtgagcatttgtattaagcacaaatattcttacactctggctcattttctgtggttcatctacatattttttccccaaaactcattgccaccaatccttcagtgtttgtctttctgagtccctaattatcttttcttttcttttcttttttttttttttttttgagacagagtttcgctttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgaaccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgttgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaagaagcattttgttccaaatcctaagaacaatagtagtggtgtgtcagaggctctattgcatctggatataaaaacaaaggggcacaatattcctgaccagttgggaattattatcttgatctcaatcccatcaaaaggtggcagcatgacaagtcatgaagtaaaaggaccaggtgataaaatgaggtctccaaaatccaaagcatcaaagttctcagttagtggtcagggctgcaaagtgccataatttttcactttggaaggtatatcttgagaatattgagtgtatgagacaagttaaaaggtcatgcagccagacgcggtggctcaagcctgtaatcccagcacttagggaagctgaggtaggcggatcatgaggtcaggagttcaagaccagcctggccaatatggtgaaaccgcatctctactaaaaatacaaaaattagtggggcatcgtggtgccctcctgcagtcccagctacttgggaggctgaggcagcagaatcgcttgaaccctgaaggcgaaggttgcagtgagctgagttggcgccactgcatccagccttggcaacaccgcgagactctgtctcttaaaaaaaataaaaaaataaaaataaaaaaatttaaaagttcgtgattaacacctctgttagcctctgatctttataataattatcacacacacacaaaccaaacaccacacatagaggaaacagtaaaagattaaaggacacagctaaaaatacatttgtattattacttcccaaagttctaaaattatgagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaagcaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatattatatgtattatatattatatatttattatatgtataatatatattatatatttattatatatataatatatattatatatttattatatattatatttatatttattatatatataatatatatctgtttattattatattttttttgagacggagttttgcttttgttgcccaggctggagtgcaatggtgctatctcggctcaccacaacctctgcctcccaggttcaagtgattctcctgcctcagcgtcctgagtagctgggattacaggcatgtgccaccacgcctggttaattttgtatttttaatagagaaggggtttctccatgttagtcagtctggtattgaactcccatcctcaggtgatctgcctgcctcgacctcccaaagtgctgggattataggtgtgagccaacgtgcccagccaactatgtaatattttaattgtgtagtgataaccctcatcaaaaggagtattcattatggtcagtgtactctgcttatttaccactaaagcttaagacaaaattgttgaaataaacatgcatattgaagtacttagctagctattgaggcaatacaggtttctagatttactcatgtttttcactgtacacacatgtcatgtgtgtcatgataaacccatgtgtgtgcatatattgattaaatattatatttctttttacttttattattattattgagaaaaggtctcactctgtcgcccaggctggagtgcagtggcacaatctcggctgcctgcagccttgtcctcccaaagccctagaccctgtaacataatagaatatgtatgtttctaatttgtgcaatatggaagcaggaatactacatagaactgtcatcttttcctattgcatttattttggtgtggaaaaatataataattggcttcagtcagtaagtctatttcattcaagaatatttaaatataatccaaaccatcttagatacattttgtgatacaagaggatggtatcttctacttggaaatataaaatcccagggtctcacagtttaagtatactttccaggggtatgtataaaacaagaatcccactttacaaagttaatagaaaaaaaaatatgctaattggaaggagaggcttctgattgaggataaagtggaaattttcacatactgctaattacactttaatggagtaagaaaaaaagaattggaaatagtaccttataaaacttctgaaatgaattacagtttctctctctctctttcttttttttttttcttgagatggagttttgctcttgttgcccaggcgagagtgcaatggcgctatctcagcacactgcaaccttcacctcccgggtttaagtgattcttttgcctcagcctcccaagtagctgggattacaggcatgcaccaccatgcccgctaattttttgtatgtttagtgacccaccacgcctggctgtctcctctttttagaattaggagaactgatttttttcaatgctaaactggcactgtcctgtgttttcaagaaagcaatatggtgaaatggaagagtctggatagcatgttttgttagctggcgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttgatcttggtctctgtcatttccattttaaactgggactgaataacctgttttgccactcaaaataatagccagtgtctctttcttattaaaatatgtgatcttttgcttgattacctaattatgtcacctgcaccttacgtgaggcagatagaagagtcttccagtctgccagagcagatctaccaaactagactgcacatacaaattacctggggatcctgataaattacagattctgagtctgctttcaaacagggcctcaagtcaagctgatggtattagtcccaggatccctcactgagtagcaaggtcttagaattaaaaagtgtgcaagtataaggccaggagcagtggctcatgcctgtaagcccagcactttgggaggccaaggcgggtggatcacctgaggtcaggagttcgagaccagcctggccaacatggtgaaaccccgtctctactaaaaatacaaaaaattagccaggtgtggtggcacgcacctgtaatcccagctactcagaaggctgaggcagaagaattgcttgaacctgggaggtggaggtagcagtgagccaagatcatgccactacactccagcctgggctccagcctgggcaacaacagcaaaactccataaaaaaaaaagtgcaagtttataaacatggaaacgtggacaattgtaagcaatattagagaactgtagaaaacaattttttaagtgatatgtttaacctatttagaataaaacccattagggtcctaggaatttctggaactgccttacttgtgagaaacatgatcctaagatgcccatttgtttatcagtacatcaattttctccttcttaaattggtataattattttcttccaagaagcctagcacacttttgttgttgtcattgaaagagggcatataagggttatggctgctatttggagaaatgcattagaaaataaaaagcttgaaaaagttgtattactgagaaaaatgttgaatgaaaataagaaagattaaattgaaataaataatgaatcagtaaggtatgcactgttaaacacttgatgggatttcccaagtattgacatgctgataacttgaaataagaatgggagaaaaggtcaatctgaattcttaaaatgttgaaggctgggaataagaagtaatatatcacagaatctgatagaaaaatttttatttattttatgggagaaaatgggagactaacagacaataggaataggaaagaattaatagaaatagcaaaaagaagtgtatctgcaattattaatataatacaagaggaaattgtgtagagatatttaaagaaagattgatgaaatttagatttatggagaaatatcctaataaagacattatttacaatcaactgttcataattattatataattctgacagtttttaggatataaatgtaaggcagaatgatctaatataaaatgtataaatgggacaacatataattttgcttaggaaattgaataaataaagtagtgatttacgatttgcattaatataaaaaaatttaaaatggtttacatcttgtttgaaatggatgataaacaggaaaaaagtaatttagtacattgagtaatttagtacattggtcaccaaagaaatacaaattgaaactataagatgccttctcccatctttgtcagatttgtaggtataaaaacagtagtagttgtattggttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaattagttaaatatacaatcacaatgagctatgacaaaatgcagttacttaaaagcacatttataagactattaatggcaataaacatgatttgatataatgttttcaaaaattaggggaattctattcctagcattgtgacagactaaatttgctgaatcactatcctgctatatgaaatctacaaataccagataaaatgtacatgtcatttttcaaaagtatattactgacttgaatagaaattaaggtgaaccacataggccaagcataaggagaatacataaatccagagaggtatgcagacccccaaaccagaagcttccataaggacagtcctggccctagtaccctgagcttcaatttttatgaccacctgggatatgggagagtgtgagacaaaacctagtgcctgcccagtatagcagtcttacaggagaaaactgctgaaagccagagatacgaaggactataatttcagtgaaaggataaactagataaaaacctgttcctcagggggagacaaccaggaaattttcctgcctcaaactcggtgctatttagaggaaaaattagaaggccatcttcacatgaatttgtggtttaaattttcactgtaagtataattttaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggatgattatataactataaaagctgtgtttaataggtttaaaaaatcaatgaggtgtgccaggaatataaattgagacagtgtatgtatcttatgttaagcagattgaaactgaacttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggataggtgaaatagaggttgaaaaattagagtatctaatcatatctgcaaaagaaaaattgaattgggggaaggttatatttaaggttatatttaatatctgagggcttttcatcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaatggattatttccattttataaaaacaactccagaataaaaaaaggtccatttgttcgttcattttatgaggccagtacaaccttgataccaatgttatatgagaaatgtgtaagacaggaaaattacatgccaactttcctcatgaacctaacggcaaacattttaaattaaaagttagcaaattaagtttagaaatctgtaaaaaagataatatagtatgaaaattgtgtttgttccatgaatgcaaggatttctaacaatagaaaaaaaactatgtataattcatcacattaacaagttaaaggaggaaaagcaaatcatcattgtagaagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagctcaagagcaagaaaccagtactgcccctaagactagaaggatcatggaagaaggtgttattatcagagccaaggggccaggacttcaggcaggttgctagagctaatgggaattgggtccatggagggaggggctatctggtgggaagcagccctgcagagaagaggcaggcttttatggcatctctcactggatagcctactgggaaaatggagggcaaaggagactgggaaataaatgttattttcctgaaacatagaacagagttggagagtaatttgggagggatctgggggcaaatttgtcaggacccaagacatgattaaagcaggcagggaaaagagatgctggtcaaagcaggtggcctttgctggtatttcaaagtcctagttttaaaactcagaggttttaaattattatcttattactaatcagatattttatacatatttaatatatttatatattaaatatttaattataattcaaaacttttatgtacactataatctcattattgttttctatactattatatacaatatacaaatacagaaatacagaaatgtacctcagtttgaaagagaatttgaatatgaggcaaaaagatacccccaaattatagttacattacaagaattgaatttaagaaggaagaagcaaattgcaagagataagaccaagcctctttagtaatgatcattctaaatccaattggtataaatttagagatgcacaactggattgcagtgtaactaagaaagtttgtgtgtcaaaaaccatagttatcctatgtgaagaaataatagtttcataggagaaggttaattggcatggagtctgtaaaagagaagtttggatagatgatcgagctatatatttgtcaaataatatctaaaggtaaaaagatctagttcacagaggcgaatctctgattttttaatttgcattaacagaaacaacattggaagggagtatattaagattttaatagtgactatttctgccaatggtttctgttttattgtttactattttcggtatatttccaatgtttcttaataagtgtttattatttaaaaaatgagaaaacagcaatgagtaattcagtaaaataaaatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaaccctacagggatttatttcctaactatgaatgtctatcttggtctagagacgactgttctcataaataggtagagtagatgtggtatttctggaatgagatttaacatctttacgtagcttgccctattaaaagtagacaaatgcttgtgagagaatatcatatacttttgaaagctaatgtcttaactaatttgctgcaagcaaagctcttgaagactctgatgtaacagagattcctaggtatcagtgaagatacggagatgaaaaagggaagttgaaaaaagaagctgagagataagcatggaaatcattttccaacctcatttttccagtctccattttcctgtattgagaagtgaaaatatgttttctagagataaagttctagaaatgaactctgacatagatattttaaaaccaatttcagaaacaaaataatatgtgaacctagagtagttgtaatttatgtccttttgtttgtctttatcctgtagttaagtttcccttgggatctctttgggaaaatggagtactgcattttacaaggcaggacttgaattttctttcttttccttctttctctctttcttcctttctttctttccttttcttctttcttctttctctctttttctttctttcttcctttccttccttcctttttcttttctttctttctctctttctttcttcctctctctctttttctcttctttctttctttctttctttctttgttcctttctttctttcttctttctttcttcttttccttccttccttccttccttcctcttcttcctttctttctcctttctttttattttttttgacatgatctcactttgtcacccaggctagagtgcagtgatgtgatcatagcttaatgcagcctctctctcctgggctcaagcaatcctcccacctcagcttccagagtacctggggctacagctgtgtgccaccacgcccagctaaaggacttgaattttcttacatatcttggccctatagagtggttctcaaccttggctgcacatgtctattacctgagaaaagttttaaataacctaatactcaggtcacaccctagactttaggggtgagacaagcattaatattttttaacactcttagaattaagagccactaatattgtagcactgcaattcctataaagagaacagatgtgagtcgatttgttacagtattgttgtattcatctgttttcatgctgctgataaggacatacctgagaccgggcaatttacaaaagaaagaggtttaatggacttacagttccacatgggtggggaggcctcacaatcatggtggaggacaaagaggagcaagtcacatcttacatggatagcagcaggcaaagagacagcttgtgcagggaaactcccattttaaaaatgatcagatctcatgagacttactcactaacacaagaacagcacaggaaagacccatcctcatgattcagttatctcccactgggcacctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaaggcaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcaatgagactgattaataaccctgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatactttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttatctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtatctttttaaaaatgaccttaatacacatcccccgtatagaatatagatcttaaacaagttagaaaataaaattttatcttttagtattacacaaaaggatgttcagaactaggctttgtattttttttttctagagataaggtctcactgtgttgcccaggttggtctcaaactcctgggctcaagcaatcctcccgcctcagtctccaaaagtgttgggattacaagcatgagatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccatgtgataaattccaacctgagaagttgctatagaacatatgaatttaacattttttaattgctgcgatctaatatgatcctaaaacatggccctagtttatattcctatgagaatgtctaatacctacactcttgctaacattgactgctattgcattttaaagactaatttgattggattgatgttgaacatcttctgttactcctggccattgcatttctttttctacctattaatctcccttgtataatattgcattattcgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataatacaggaaaaaaacctttacagagattattcttataatgtttgtgatacaatatttacaggcaacataaattctcatccagagatcagagtaaatattatatagtatatctgtagaatgaaatgtaccttgctgtttaaatgaataaattagttattatcataaaataaatgtcatgtaaagacatttattttatggtgtataaaattagaaaaacaagttattaaaaataacatgattttttgtaaaatgcttttattttgtttttaattgacataataattgcacatgtttatggggtacagtgtggtgctttagtgcatgtgtacattgcgtaatggtcaaatttaaaaattaaatgtattgatagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatattgtacttgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttcccaaagaacaagagagaaagatcaaggaaagtgagaagcaatgaaactagatttaattaatactctggcttgtcagcagccagatttgtttgttgaagaagttgaacctattagcttaaacagggattaactctgccaactctgacagagcatggacaattaagagtttattggaaattaattgaaaataatacagtgttgtgaggtgggatgaagatgatttcctttaaggaaattatgccaagtgttttgaatcagccaaggataaacaaatgcagactatcatttgatggaggtattataaactgataacatgattcaaagtataagaatggcaaattgtgaagaatgaatgaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatatcaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagcttgggggttaggatttcaatatacaaatttggggggacataaacagtcagtctgtgacattgccatttcgtcagtaagaattttcatgaactcactattaagatttatgtttaggttttttatgtggatgttctcactttataatattgtttgtctgcatagtttaaagaaaaggacaatgcccaattagaacaggaggtgtcttttgttggccagcaaaatattttaagatgccttgagtgtgaccctacatagagatcattaaggtaacatcattttgttcttgttatagatccacatgtttcactcaagatcccagaaagaaaatgtatgaaaacacattggaagacaataatccatccttacaatgttagccaatgtttattattgctttctatgtgtgaggaattgtgttaaacacttaaaaagatgttatctctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcacccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattgtggacctttaacccttaggccagatagtatatgaggcctagagtagtggaaaaaggtaactggatttacaaaatttgactcttcaaattctgtaagaattcaatatattgaggaaagtttaggtgcatagtaaaattataatttcatattgttgcacagactcaggcagatgaaagagactccaatagtggtcaggtagtacccagacagtcagttgattgtctctgtgctgaaaggatttaagaatgaagaagagtttgctccaatgtatgtttcaatatctcattgttttacaataatatttgaaataatacctaggaacccaacttacaagggatgtgaaggacctattcaaagagaactacaaaccactgctcaaggaaataaaagaggacacaaacaaatggaagaacattccatgctcatggataggaagaatcaatatcgtgaaaatggccatactgcccaaggtaatttatagattcaatgccatccccatcaagctaccaatgactttctttacagaattggaaaaaaactactttaaagttcatacggaaacaaaaaagagcccgcattgccaagtcaatcctaagcgaaaagaacaaagctggaggcatcacgctacctgacttcaaactagactacgaggctacagtaaccaaaacagcatggtacttgtaccaaaacagagatatagaccaatggaacagaacagagccctcagaaataacaccacacatctacaaccatctgatctttgacaaacctgacaaaagcaagaaatggggaaaggattccctatttaataaatggtgctgggaaaactggctagccatatgtagagagctgaaactgggtcccttccttacaccttttacaaaaattaattcaagatggattaaagacttacatgttagacctaaaaccataaaaaccctagaagaaaacctaggcaataccattcaggacacaggcatggcaaggacttcatgtctaaaacactgaaagcaatggcaataaaagccaaaattgacaaatgggatctaattaaactaaagagctcctacacagcaaaagaaactgccatcagagtgaacaggcagcctacagaatgggagaacatttttgcaatctactcatctgacaaagggctaatatccagaatctacaatgaactcaaacaaatttacaagaaaaaacaaacaaccccaacaacaagtgggagaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacccaaatgtccatcagtgatagactggattaagaaaatgtggcacatatacaccatggaatactatgcagccataaaaaaggatgagttcatgtcctttgtagggacatggatgaagctggaaaccatcattctcggcaaactatcacaaggacaaaaaaccaaacaccgcatgttctcactcacaggtgggaattgaacaatgagaacacatggatacaggaaagggaacatcacacactgtggcctgctctgtggtggggggctggggggagggatagcattaggagatatacctaatgtaaaagatgagttaatgggtgcagcacaccaacatggcacatgtatacatatgtaacaaacctgcacgttgtgcacatgtaccctagaacttaaagtataataaaaaaaaattaaaatattctgcagtcacagtgactgtcttggcttctcttaatttatgaggacctttgtcttatagactcttttttaaaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaattttaaaaaatttttttcatctcttacagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatccacatacaacttttgattccccccaaactactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcgttaagtggaagtggatcatcctaaaggtcttcatcattgttgtcttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacatttcagtgtagtacctatcagtcttccaccatttgctttagtttcagttcctgtatcattgaacggtctatgtcataaaagaagtcaaaagtagtcttgaataatcaaagctcttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttgcaacccttcactccacacctttttttcccttcatatccatacttctttccatggttttctctaaattgggtttgtcgtaattctgtagctatgcacaacatctggacacaaattgtacttttgtccagcaggaatttattgttttgagtttcatggttttctatatcaactgatgacatcttgaaaggtgtaagccttccagacttccatgatgttctctgtattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttagtaataaatgacctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcaccttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcacgaaatgaggccttatgaatttctcttttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgaaagaacacactatttacttagatacagaatttactgaagagaccaagtgctcatggcagatactggcaacatgagctcaccacagtagcaacagggggtggctacaaaattattataatagtacatacactggaaagtagacgctggagaatattccaaaagatgccagggttggaggggagtgagggttgaaaaattattattgggtacaatgttcactattggggtgatgagtacagtaaaagctcagacttcaccactagcaatatatccaaataacaaaacaatcatataataaaagtatgcttgtacctagcacatttataaaaataaaataaaagtaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaacatatacatatactttatgcattcaggatgtacatagctttttcttaatttttttcttatattctaggctatgcagttagtctgctagttttttcaattgcaattctccaaaactttttctgatatatttatttttttaaaaaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcttaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaatcatgatgagtctccatcagtaaaaagatagtttaaaaacttgtagaatttagtcatatacatatatttacacatgcatatatgcacacatattatttttctctatatagagaaactgtgcattcatttaaagtgatatttcctctttttgttaattgagttggagaaatgttcatactgtattgataagttggaaaatcagtttgtttacatgaggtgaagtggaaaagttaaactacattataaagtacattataggcttttcaaaggacaaaaaagtgtcacctgagatgaggcaatgaagtgctcatggccattcatccctattttacaccaatagaaagaaaagtttggaaaatgttggatttctcaataaaatttcaaggaagtagagataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaacccacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataaagataggattagaaggtagactttaggctagggttagggttggaaaaatcaaaacacgttgttctctttagagtgagaaattggtttatcccagactttgaaagataatataatctataaccctctggttacgggaaagaagagacctacatgtggccatcttgggagcaaggcagagagcaggctggaagatcttctaggatggatatggacttgtgaaatgcagtagttaaacaaagttttctcagagttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattcttagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctatggtcaaagttctctccttatttgccagttctttttttcatgtcccaatcataatcttaatggtatcgttgatcactcaagcaactaaccctgaagactgcccagtcacaggagccaatacatctttttatgtttaaactcaatcacttcaaatgttgatcttaccttgcataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcagatattacgtagtgaggaagcagtgggtgagaacattcagtgagagaccacaatgtaaggagaaagtctatctgaccagtggaagcagagactccagactcagaacctttggtacgaagagtaactacagcaaacgggcaaagaatagattgtgaatttggaggttatgtgcttccttctggcacatgaaaaaactcctaaagctttttgtgggtccaaaatgaaataaaaatctttccccattggtatgaaaataagttaattagcttttacaatggtttgtttttgtgttactagtttccagttgtggctgtttctctcagtttctctctgttttggtttgtttgtttgttgttgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcttgaaaaatggagagctctaactgttggtagggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacgtctctaccataatctataatctgactggataaggactataaataaatagcatatgaaagtctacaataaagcagggagaaaatcatcactggctccgaatttgataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgctatgtcagaaggcgagaagcaagggaaggcaggcgggtaagagaatcacataacgcaaaggacttcagtgcttcagaacaaaattgaagcgtttcaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactcgatttaaggctcagctgaattgaattattaaactagtattttttaaaacatttgttcctgtaacttgagatggggctacaaataattatactgtataggtaaaaccacacataccctacctggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggataagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtcaatttgttaaatggatggtctcaaaaaagtcatattagtatttgggttacctttttgataaaataataaatcaatctccatatattagccttttttttttttttgagacaaaggcttgctcttgtccctcaggctggagtgcaatggcgccatcttggctcactgcagcctctgcctcccgggttccagtgattctcctgcctcagcctcctgagtagctgggattacaggcgcctgccaccatgcctggctaatttttgtatttttagtagaaatgggatttcaccatgttggccaggctggtctcgaacccctgacctcaggtgatccaccctcctcggcctcccgaagtgttgggattacaggcgtgagccaccactcccggccatatattagttttttagcaaaaatttaacacttgtattctccacagtgtcctaccggattagatatagctctcctggactaaattgtttctcacccacagcaatattgccatccgggagaaaagagatttatagtagtttactttgtactcctagaaatcctttcaagaagtataaaagtgaatacatacatatttaaatgataaacatttatctttgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccactgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagttttcagaagtcatgttatctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagtagtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcgttaacttaattctgcctttcacatgtgagctcccaatttcccttgtggctatgagccacaagggcccaaattcaatgggagggtggttcgggtctatcatgacaagccaggatggaggagacagaggtcagttattgggagcccagattcttgccctttagaaacatgtgctgtagcagagaggaacccactacagctgggatcctggactgacacagcgagtgggtagtccatccagggtcacctgattgatagcaggcccttcacatctgcagcccccacctgtgacactgtttttgataccatattccccaaatttaaccctcaaatccaaaatagtaaaactactgagatgttacttatgaatacagtatctctgggtttctcagatggctgctgggaaactccagagatcctcctcctagctcttaacatgaagatatattagaaataaaggtaatgttttgcattctccagatatttaattggctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttctcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgtcgtttgctatggcaaaaaattaaccaaactttacagttttattattagcaacatctcctccccctatccccgctgcttttttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataacggtagcagacactgttgatactattgataccacaggaaattgactcatggatataggcctccaagaataggctgaccttgtccccacagacaatattccaactatacgaagtaaatgagtcaggagttccaagacactcacaatgtagaagcggatgaattcatgaaagtagactgcttaactcaagaccagcacgacaagaggttgttatttaggattaaagggcctcagtaaggcaatttaattgaggttagtttaattttctactttaatgaacatgagaacaacccattttctttcttcttaatctacctttaatctccaattaaatttacaaattattaaatttgtaaaaactaaataaaacactctgaattcttagtgttgagggaaaaaataccttgcagaaattcttaatataaaaacaaagctaataagttgccaagaaaaacatacaaataattattttgtaaagaattgtgacatacaatatttggttttgtctattaacatacccttaattagcaatattggttaaatcttgcacaaagtttctttaataaaaacatttactttttgtgactatgtagttatttatattggttcaataagaatttgtcctcccttctacctgaatatattactaattagaaatttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctggggttacaggcatgagccaccttgcccagccaggaagaatcaattttttaataaaaaatttatatctgtgctacaaattcaatttaactagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtttggtctgctctaaactgagctgttaaacatgtaaaagtaaatttaaaccacaagggctttataaatctatagatagacgtaaacttgtgagccttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacatcggggcctgacaccattgtcagcccattcatcatgtcccactgctgaagaaacagagaaaaaaaaactctgcactctgacataaagaaacaataaaagggtctctctgtctacctgcagtcctccaaatgaataaaaccttgagcatttcctgagagttgctaactccttaatgaaaatcactttatccttgactttacaatgctgtttattgtctgaagatatgtcatgaactttctgaatataataaccatgataaaattgctgttttctgccatgaagagattaatataaaccctatagtcttcataatattgtttgtcttaaaaagttctatttttttaattttttgggcagttcttttgaagaatgacttcctcacatttctttgcaagtaaatgcctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttctcatctgcaaggaggatttaaatatttctagctcagtagttcagccctgaagattatttcacccccactgctaatcccgacctaatctgtttttgtgttgttaatgctcctatatactagccaggtcagtaattctgtaacaggcttaatttcttaatattttaggccatgtgttaattttactatttcttagccattttttcctcaatagttttaaattgcatccctgcttactctcccttttactggacgggcttcctctgtttactaatacaattccccaaattgattcatccacttgttgaaatacctaattttaggccctgcactgacagcttgcctaggcttatacttgtgtttggtgttgcagtcttcagattctaaaaacaccatctagaccttacattacctccagccagggctattcccccagggcctgccttaagaagcagatttcttttcaagtttcatcttcttcccatttatttcatttcatgacagttagagaagctgtatactaacgtgacaaatggtaagttagcagagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagacaggaaatgagatggaattgataaggcaatgcaaataattcaggttatttagatcatcagtgttgggggaagctgggtttatgggaatcaatggttaatcagaatgtgagcaccattggtttggtaattcatggaagaggttatcattcaacagggggaggggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctggataggccccttctgtttgataaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataacgtttccctatttggggattggttaaatgcaatattatagaagtctgaaaaaataatgacggtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggaaatgatttctagtttcagtttctattttctgtcaattaaccatcattttggtaaacagcctttttaaatgtcttttcttttaatttttaaatttttactttaaagacagggtctcactatgttgcgaaggcattggcctcaaactcatggactcaagtgatcttcctgccatagcctccctaggtgcatatcaccatacccagctattaatgtctttataaaagcatttttaaccctactggtctagctattgcatcaaataaatagctaattccattgaggaaggattagggactcacgagtgaaaataaatgttttatttggataatggctacaaaatctcaacagtcaaaataaataagagattaaaggcatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatgtctgtctccatattatcttctctctcattgcactttggacatttttattcttcctgcagatctatttttatgaagcaatgtgatttaaattaaaagagcactgaattctcagccagatatttgagttctagttgaagatttatcacctagtggttatgagatttggggcaaattacttaatctctctctttctttaccacttcatttgtaagttttcttgcctccctacaggactgtattggggatcaatcaatgttgagttgaaggctacatggtttaagttggcttaatggagaagtggtaaatcacttaaacgggtagaacaacacagtgtagaggatgttgggctgcatgaggaagtgtggaaaaaaagcatgccatgaaaatatcatcacaatctcacatttcttcatttatttgcacactctgaacacatgcatgtgataaggactgtgcaaggttctcaggatacccaggtaaaaatcaccacttctgccagtcttgactttgcaagcttgaggagcaggcctggagaaatttggctattaccacaccaaagttgttcctcacattccctttgacatatggtctcaggaaaaaatgaaaagagtaaaaaaagaaaaaaagtccttcatttttgaaaggaaaagtcataattaatttctagaaggagaaagaaaaaaagagataacagtgtgtgaaaaggcttagaaaatgctagagcactacagaaagataatgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattatgcacatttttaatgcttctatacaggactgaaggccaatattaccatgataataaggcatgtaacaaaaatttgttctgcagagagtgagaaagcgtgagggaaaacacagtgcaggattctatgctgttgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacatgccatgaaaacagttccagtgctgggccagaaatcaggaaacatgggcttttgatttctcaccattaaaatgaagaagttggatttatacccaagggtaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggcccccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggatttctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctctcaaaggccccagctgcataaatcatcacagtaggtgttagggcttcaacatttaagtgcgggagttggtgttcacatttcagtcaattgaggtgacaattgaaatgtgaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtgatgaaacccgctctctactaaaaatacaaaaaattagccgggtgtggtagcgggcgcctgtagtcccagctactcgggaggctgaggcaggagaatggcatgaacccgggaggcggagcttgcagtgagccgagatggcaccactgcactccagcctgggcagcagagcgagactccatctcaaaaaaaaaaaaacaaaaaaaaaaacacaactctctttaaatcacacatccgagtgtgtcccttgtttcccaccagagccaagactgaattgagatgatttcttaaggtcaggttgatgtcctaatccagttgtgctgctataacaaaataccacagagtgagtaacttataaacaacaaaaatttattgctcacagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggaccacaggtgctcaccaccatgcctggctaattttttttttttttttttttttttttgtagagatggggtttcaccatgtttcccaggctggtctcaaactcctggactcaggcaatctgccagcctcctgagggagtgctgggattacaggcatgagccactgtgcccaccccctttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccatttcatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgcttgtttgttttgtcaaattgggattatttttgtgtctttggagaatataaaatactaatatgaggtaagcactaaggttctgagatggccgtggaagagatgacaaactccatcaccatgcctgagagtgtccaatcgtctctgcgggggccacatatttttgtattacactgtatttgaaataacaacaacaacaaaaaacccttcaagattcataaaattggacaactgtctttgtaacacttctagtggtaaaaccagtaaggatggctagtttgcaacccatctgagcagcctctctggtttcatagatatgttttctctctgacattgaatggctttcaacttgaagcggaatgctacatcacaaagataaacaggtttgaaaggaaccggttttccttgtaatcctaaacgttcaagtctgcgcattaaaagacattatctgaagaagggtgcaaaagcttcctgttggccgccagaagggttctctgcaggacacagatcaagtaccacagtcttagggggagaccagacgcggggtctctgcgcacctccccaaaggacaatggcaggaggaaaaggagaaagagacagacgtcacttccttcgccagctccggcagcgggttgatcggctgagtcggcggagggtggggcggaagagcagacggggactgggaaaggcgctgttagtgacatcacggatagggcgatttctatgtagatgaggcagcgcaggggctgctgcttcgccactaaggagttcccgtgccgtgggagtgggttcaggaccgctggtcggacctgagagtcccagctgtgtgtcagggctaggagggctggggggggcggggaggtgcgcggggcaagtgaccgtgcgtgtaaagggtgaagcgtgtgaggctgtggcggggcggaggtgcaaaagctcatacttacctggcaggggagatactattatctaaacgaaggtggtttttctcagggcgagggttatccattgtgttccggatgtgctgacctctgcgatttccccaaacgtgggaaactcgattgcataatttgtggtagtgggggactgcgttcgcgctttcctctggtgcttttgtggtgcgaatagtaggtgagccgtaagtgtttttgtaattcagggtgcgggctcgtgttttgtggctgtgttctgtccggtcagttgtttccgttcgcaacggttagttttcgtttgtgaggccatgtttggggacagcttagaactatccacttactctcttgggaggcgaatttcagtctctgttggttggggtgttctcccaggttagctgccgctgtacttgctaggtggagctcagggatcaagggtcgggagctttctggtttgttcagtgctcccagggcttctaacatctcttaaaaactctggtgttttctgtcatcctcggagttacctcttagcctctgttttttttgttgtttttttccccccctccctaagacaagtctcgctgtaccgtccagtctggagaagtggcgcgatcttcccatctcaggctcccgagtaggacaaccacacgccaccacacctggctagttttttctctttttttttcttttcttttctttctctttcctttctttttcttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgttggggaaacgtgtactcagttaatagagccaggtggaagttgtactcagaactggtggttttctttggaatgaaaaccgtgcatgttgggggctcttagtgtccccgttcggttgtagacataacacccttgctttgtgtagggggagggctttgcccatgccctggtgccctggcgcagggcatcgaggcctgcaggtcagaaccgcagtctaacctatgtcttggcggaataccctgctaattctccctggaatgtaagatgggaggtcttgtgaggaggtttctacaagtaagaaaacaaatttccattcggtttttattgacaaaattgaaaattataataactgagtccagcctctcagatgacaaatgtcttttgcactgagagctgggaaccgccgcttgcctcagctcctgcatgcaggtgcagccctcgcttccctccacactttctccagcgggtgtcagttcctccacaagaggcagacagcgttctgcagaaccacagcgctcaaggccttcgagagccaaaaatctcggagcgagctgccctgtcctggctgtacctcacgactgacctagaaatggcctttgctgggagcaaagggtaggggggagattgtcgtcggagctggggcctgtgcactggaccaggttgaccacgggaggggaggtacccagagttagaagggggccaagcactgagacctcaccatcctcaatctccaaaaggactcagagagatgcagagactgagacaggcttcctttttcaaggaaagagaaaactactgaggaaggccccaggggctctgaaccaaaatccagacttttttttccacctgcagctttttgtttttatttttgcttgagaaggggtctcggtctgttgcccgggctggagggcagtggcgcaattttggctcgttaaaacctccatctcccgggttcaagcaattctcctgcctcggcctccctagtagctgggactacaggtgcccgccatgacgcccggctaatttttgtatttttattagagacgaggtttcaccatgttggtcaggctggtctcaaactcctgatctcaagtgatccacccacctcagcctcccagagtgctgggattacaggtgtgagctaccgcgcccagcccgcacctgcagcttaatcccatttcgctggtgcaacttcatccttccgtatgctcaggccaataaacagtactgtaggctggtcgttctttgacccccatacatcctattggtcggaaaattatgttttctctttggttaaccgcagactttgatatgcacactctttcttggtctgaaacccacccaatagtcccatacgtagatttttggataaacatagaaatggacccttctgatctgaaagtttgaaactcgatatttgttttatttgagttccttccttcaggcctctcaaaaaagatatcaaagaactgaaagtcacccagacaatgagatgccggacccctcattcatcctgattgcttccttgcccctccctagttcctgttttctttcttttcttttttctttttttttctttttgagacagagtctccctctgcctcccacgctggagtgcagtggcgctatcttggctcactgcaagctccgcctcccgggttcacgccattctcctgcctcagcctcccgagtagctgggactacaggcgcccgccaccaagcccggctaatttcttttcgtatttctagtagagacggggtttcaccgtgttagccaggatggtctcgatctcctgacctcgtgatccgcccccctcggcctcccaaagtgctgggattacaggcgtgagccaccgtgcctggtctagttcctgttttcttacacattgtcacattctttccctgccatctaagcctctagttttggttggtcagggagatggatttgagactgagttctcatctcctccgctgcagcaccctattaaagcctcttccttggcaataaccatctcagtgattggttttctgtgtggcaagcagctggaaccccaggtctctgaactttggcaaaggaatctcctgataaaggcgagatcgattttactgaccaagctgaaaacgatcagacgtttgaaagccttaatctcggagcctgtcggagtttggtctgcccttgaggcttttctttgggcctaccagtcaaaatcagcctggccaaacctgtcttcaaggaccaggggcagggccggcttctcccgccgggtcggcagccaccttccccttccctgtgacttgaagagaagcttcagggggcgtttattcaatttgcgaggagcccgcgaggagcaggtgcgcggtgactctgtggatcccaccgcacccgctgccctctttggtcctctcgctgtcaccggcgggcagtaacgttccgggtgagctagggctccgaagacagcaggcagggagggaccagtgggtaagggcaccgcccgtttaggtcctgcgcaggagggatccgaaaaaggtcttgaagaaatagaaagggagggccagatgcggtggctcacgcctgtaatcccagcactttgggaggccgaggtgggtggatcacgaggtcacgagttcgagaccagcctggccaagatggtgaagccctgtctctactaaaaatacaacaagtagccgggcgcggtgacgggcgcctgtaatcccagctactcaggaggctgaagcaggagaatctctagaacccaggaggcggaggtgcagtgagctgagactgccccgctgcactctagcctgggcaacacagcaagactctgtctcaaataaataaataaataaataaataaataaataaataaataaatagaaagggagagttggaagtagatgaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtatcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttaccttaagcgcactgttggtggaacttaaggtgactgtaggacttatatatacatacatacatataatatatatacatatttatgtgtatatacacacacacacacacacacacacacagggtcttgctatcttgcccagggtggtctccaactctgggtctcaagcgatcctctgcctccccttcccaaagtgctgggattacaggtgtgagccacctcacccaggccattttaattttaatttaatacttttaatttgaatacacaatccaaaaatcatataacaagtacaggaaacccactttatgccaagtttacaaaaacaggaaagatatgtcaatgacaaagcgtcaaagtggcaacatcctaaagtactgagagaaaaaaagttattctagaattctatgccaaattgaaatatctttcaaaaatgtgactgaaatcaggacatttaaagacatacaaaaaaatgacagaattcaccgaaccacactacaagaaatattaaaggagtcctccaggcctaaggataaggataccaaacagaaatctgaacctacacaaagaaatggagacgactgaaaatcgctatgtacgtacttggatgttggggtttataacatgtccaaaatcaaattccctgacaacactagcataaaggccagaaggggaggtataatgtcacttgatggcagacagataaagatgtattctagggaccctaaagccatcactgacataacaaaagaaagagttacagctaataagccaaataaggaaagaaaatagaatgatatatattaaaaaaaaatgtaatcgctgggtgcggtggctcatgcctgtaatcccagcactttgagaggccaaggcaggcagatcacttgaggtcaggagtttgagacctgcctggccaaaacggtgaaaccccgtctctactaaaaatacaaaaattagcccgatgtggtggctcgcgcggacctgtaatctcagctacttgggaggctgaagcaggagattcgcttgaacccgggaggcggaggttgcagtgagagctgagatggcgccactgcactccagcctgggtgacagagcgagactctgtctcaaaaataaataaataaataaacaaacaaaaactgtgtaatccctatgctggagcaactgctctccaggcctctaccctatagaaatacacaaatggccaatgagaagtgtacaagaatgatcactgccgcattatttgcaatcataaaatagtagcgccaaagtaatttcaaagatacatgaaaatcgttttatttatttaacaaacacaaacaattgaacaaacaatggaagcaagtccttttgcctaaaggaacacagagggtcatgcggatgttgctcctccaaggatttcggtgttccccaacggctagttttgggtctagttcttctggaagaccttattcttggggagctacaggttctggcgtttggggctctttcaggttctatctccattttcccctcaattcctccccattctgctataataaaaaaaaattctcacctccggaagatcccgcctgtgcctccccgccagcctttcaggaggtctggacgtctggtccaccgctccccggcttctttcaccgcttttgcttttcccttcccctgctcccgccctccggcctcaggacccgaccaccgcccagctgagcccccgcggctccacggcgcagaaggtgcactggaggccctgcccgttgccgccccgcggggtgccaagaagtcaacgtaaataaatgctttgtaaaaggaacttccccatggaaaaatctctcatgatttccattctcaaggctcttcaaaggactaaaagctaaaaggatggattcattcgacaagtcctagtcctgcgccctggtgagtgccagaccctgctccccacgagggggacccacgagccaccctcaccacgatccctgctctggtggagcccccgtgcggaacacaggatccgaagatggcagcggaagctccgcagcggccccaaaagcgactgggcagggagggcacaggctccctcactgggtgaagtcggcgcaaagaacgggaagagccatcccgggagccaccgggcgttcagcctccctagggcccccaggcggctcgggccggggtctcaaccggggcgtttccgggggtttctgaagcaggcgaggggcagggcgggccaaggccattcggctatccttctggctccagaatctcccaacgcgcaggtgtccaacgtgaccagcgcgacttaccactccaatctctccggtcttccaaggccttgctcagtcgtcctgccgggcgggccctgaggatgcaagggacggaggaagtttcgtgcgtgcgcccttcctatagcgcccagtagaactgactgacagtacctgtctctgtggcgtagtcggttagcgcgttcggctgttaaccgaaaagttggtggttcgagcccacccaggaacgcttgttcgagcttttaaagtattcatgcattgtcaatcactagataaatggggaaaattttatcttcctggagtcctaagccactaatttgtgacttatccatgtcaagggccagcctacctccccgaccggattcttaaccgggtatctcctgaaatcctgggtttatacgtgtgtaactcaggaatcctgaaacagagacctaggaacccacttctggtgtgataaaattctaattcagtccgttatacgcttaaacgagtaatttacatgcctccattttttcatattttaataataggaggtcagtaatatcccgaggatgtgcctggatttactgattgctctatcaataatgtgaccagtggaatcattcatcatcatagtgatcctctccatcatttttgaaaagagtatttttcctcagtttgtgcatgatttatttaacccttttcaaaatgtttttgttagccaggcatggtggcatgtgcctgtaatctcaggtacttgggattctgaggcaggagaatcatttgaacctgggaggtggaggctgcagtggaggctgcaccagtggaggctgcaccaatacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccaatagcaatatttataggaggaaaaatgtgcagaagtgcaactgagcttcgtgcctctccatggggcccatgttcataaaatggtggcattagcaatcatctgagagtggagtttgtggccctctgacatcaaaagctgaagcagaggacatgaaaaccctcactgtgcatcctctctagtctggccagaatcattcctaggtcggtggtctcttatcaggagggaatgctgcttgcttgttttgtcaaaatcacaaaactgaggaaaagcatcaggccgttggttgataacagtggtgaagcaagtctttccatagggctggtttgttgttaacccttagggaaaaaaaaaaagccgtttttttttttttgagacggagtctctctctgtcgcccaggctggagtgcagtggcgcgatctcggctcactgcaagctccgcctcccgggttcaggccattctcctgcctcagcctcccgagtagctgggactacaggcgcccgccaacacgcccggctaattttttttacttttagtagagatggggttttaccgtgttagccaggatggtctcgatttcctgacctcgtgatccgcccgccttggcctcgcaaagtgctgggattacaggcataagccaccgcgcccggccaaaaaagcctaattcttaccagctggtgccgtgcagttccaggctcttggtgtcccaaacaaagacaccaagagcctggaactgcaccaaaaaccaaaaccaaggtaggggcaagatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttcaaagggaggaaaaccatcaaaaacatttttagtgcaatatttaacatgagctatacaacccttcctaaatgccaaaggcacacacagacacacacacagacacacacacacacactcacactcacgaagaatacaaatgactagaaccaagcaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccaaaagtccagagtgatagcaaaaggttttaattgtatagattaaaattaactttggacaaaaattaaaactcaggcagagaatgttttcttctttttgcaacagcagacactagtaaaaacaaaggcacagtaaaaattgagacccaaaatttgcagtgtagagatatgaatataataatagacacaggcagggaggattaataaatgataaaatgtttagaggatgatcattagaatacaggatatttatactcttgaaaaccgctttcccaagtacttcattataagtaaggtgtctctaaaagggacagatctcctagacccctccttaaccaagtaaccagtcctgatatcataatggtgatggacaaactagaccttctctgcccgcagatgggctgaggttggaaactcacagcattgtctctgcagtgttcccggcaaaacgtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttactttttttcaaccgaaaatatctcttctcctttttgttgtgtgatttgtggtgatatggactatgtgaaggagacaggtcagttgtcctgctcagtgttctacattctgcagttgtctggtgattacctcctatgaaactcaggttaagcgttttctgcaagaacatggcattgctcatattctgcaccggcagagtcctgggtgacatgctgtctcctgccagcggctcctgactcctgttctctacaggatggaattgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttacagatggatcagctaaaacaagccaacactgaagacacaaagaatgaggttaggttcattgaaaccagggtaacacctttggatgagctaaacacaaagatgacaatgaccttgagcaggtatagaagctcagagacatgcctgcaaaatgacatccctgaggaattttgtagctacccagagatacgtggttcaaattaaaatgtctgactgatcactcccggcatgtgctgcacagttatgtgaacgtgtcacacctaacgtgggtccattgtcttcagactgagcacaggttgccactggcatggtttgagaataggaatagagccatgcccactgacccatcctatgtctgggcttccaaatggaactgtactttcattcaaatcttcacgtgcctataggtcctgcctgcaggaatgacacctctcggcttagtaagggctgcttattgtgggaatatgactcccatctggaacaccaggtggagacttgtcaccgtcaaagtaaaaaacctattgtccacgtaaagggcgaagctgatatgctcttcctcaaatgagtaaaacacacttctgtagtgctggaatgagtcaggtagttcaaagtacattgacggagtcgaataacatatatccagtgagtcctgcaagacttcaggctcttccacttccatcagcatgctgttgagcctgcaaaaggagacaaaactaaagaagcagccagggaaaatcggacaccacagagccccactagatttcagaagtaacataaggaagtggttagaaaagaaaaaggatagatccattaatgaggtaaaaaaaaaatttattgcctttatgttgggatagaacagggccaggtagaaaacaatgaaagagaaagacagagagagagagacagagacagagacagagagaaagtgacctagtgaattggccaggtgacatactggtaagggagtcaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctgtggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcatgatagaaattcctcggtttttctcccagaaactgtgggtaaaatgtccctattctagtagatcgttatcccaatatcatttgtcccaaatttgtgcaaacagttatgccatatttttacaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagaataggatcagggcgccacaggtatggcctgagactaggaagagagtcttgctcactgacccatcccttgtctgggcttccaggtagaactagagtttcattcaacctacatgtgcgtataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagagagagagagagagagagagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgagaaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagagatgtacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatacttctgtgaattttttacatctgcctgggtccaatgtgctgagagcgggctcaggttgccacaggcatggctggagactaggaatggagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcatagtaaggtactcactgtccacgtcaagagccaagccaaggtactgttcctccaatgagtaaacagcactgctgtagggctggcctaagtcaggcagttcaagataacctgaaggagtcgaataacatctacccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttaggttgggatagaccagggccaggtagaaaagaatgaaagagaaagacagggagaggcagagagagagagagagaggagaaagtgagctcagcgagttggccgggtgacacactgatgaaggggtcaaaggacactctgagttagtgccctcgggacacacagggaacagtgatcatgaaaagagtggactcaataattttccataaacttgctcaagattccatgcagttgccatacagcctttgaggtatggtcaacctatagaaagttagtaaatgataaggggaggaagaaatggaaacctaaacatctaccgcaatgaaaaccaacagcaatgtcagtaggagtaattcaaccttcgttgaaaacatgaaattgaacacactcttgttttccctggacctggcatctccaggtgtcaacacagaattcagcatccataattgctcaaagttacctggggcatgatgggtcttggtcttcttccacttcttggtacttttcaatttctgcaataagttcagacatggacagatatattaagctggttctcctacacacataacaatccactgtctaatcttcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaattgcccccaaatggttgctaggagaaaaactgcactattcagccctgtctcatcaaatactcagattgttcatggtagcgaggattttagacgctgaaattagagtgaaggatgaaatctacaagatctacaaaattgagacaaaatcagagttgtgtgaatttgtcacatctgcccaggtccaatgtcatgagagtaggattagggcgccacaggcatggcctgagactaggaagagcgccttgctcactgacccatcccttgtctgggcttccaagtggaactagagcttcattcaacctacatgtgcctataggtcctccctgtggcaatgacatccctcagctcagtaagggccacttgcagtaggaatatgaccctaaccagaagactcagtggatccttatcaccttcatagaaaggtactcaccatccatgtcaacagccaagccaacacgctgttgctccaatatgtaaaaggcacttctgtagggctggcatgagtcagtcagttcaagacaacctgaaggagttgaatagcatctatccagtgactcctgcaagacttcaggctctttctcatccaacagctccccgctgagcctggaaaagtgggaaaaagtaaagaataagccagggggaatcagaaaccacacagctccagctagatttcatggctaagataaggaactgtttaaaaagaaaaaggacagatccattactgagggaatgaattattgcctttaggttgggataaaccagggccaggtagaaaagaacgaaagagaaagacagggagagggagagagagagagaggagaaagtgagctcagtgaattggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttactaaatgataaggggaggaagaaatggaaacctaaacatctactgcaatgaaaaccaacagcaatgtcagtaggcgtaattcaaccttcgttgaaaacatgaaattgaatacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagcgaggattttagacgctgaaattagagtgaaggatgaaatctacaagatctacaaaattgagacaaaatcagagttgtgtgaatttgtcacatctgcccaggtccaatgtcatgagagtaggattagggtgccacaggcatggcctgagactaggaagagagccttgctcactgacccatcccttgtctgggcttccaagtggaactagagtttcattcaacctacatgtgcctataggtcctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatatgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaataaaaaggacagatccattaatgaggtaacaaattattgcctttatgttgggatagaacagggccaggtagaaaacaatgaaagagaaagacagagagagagagagacagagacagagagagagacagagacagagagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctgtggtacgttagtaaatgataaggggaggaagaaatggaaacctaaacatctactgcaatgaaaaccaacagcaatgacaggaggagtaattcagccttcgttgaaaacatgacatcaaacacactctggtttccctgaatctgttgcctccaggtgttaacacagaattaagcatccacaattgcgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcatgatagaaattcctcggtttttctcccagaaactgtgggtaaagtgtccctattctagtagatcgttatcccaatatcatttgtcccaagtttgtgcaaacagttatgccatatttttacaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagaacaggatcagggcgccacaggtatggcctgagactaggaagagagtcttgctcactgacccatcccttgtctgggcttccaggtagaactagagtttcattcaacctacatgtgcgtataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgcttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacagagagagagagagagagagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgagaaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagagatgtacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatacttctgtgaattttttacatctgcctgggtccaatgtgctgagagcgggctcaggttgccacaggcatggctggagactaggaatggagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcatagtaaggtactcactgtccacgtcaagagccaagccaaggtactgttcctccaatgagtaaacagcactgctgtagggctggcctaagtcaggcagttcaagataacctgaaggagtcgaataacatctacccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttaggttgggatagaccagggccaggtagaaaagaatgaaagagaaagacagggagaggcagagagagagagagagaggagaaagtgagctcagcgagttggccgggtgacacactgatgaaggggtcaaaggacactctgagttagtgccctcgggacacacagcgaacagtgatcatgaaaagagtggactcaataattttccataaacttgctcaagattccatgcagttgccatacagcctttgaggtatggtcaacctatagtaagttagtaaatgataaggggaggaagaaatggaaacctaaacatctaccgcaatgaaaaccaacagcaatgtcagtaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagtgaggattttagacgctgaaattagagtgaaggatgaaatctacaagatctacaaaattgagacaaaatcagagttgtgtgaatttgtcacatctgcccaggtccaatgtcatgagagtaggattagggtgccacaggcatggcctgagactaggaagagagccttgctcactgacccatcccttgtctgggcttccaagtggaactagagtttcattcaacctacatgtgcctataggtcctccctgtggcaatgacatctctcagctcagtaagggccacttgcagtaggaatatgaccctaaccagaagactcagtggatccttatcaccttcatagaaaggtactcaccatccatgttaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctctctgctgagcctggaaaagtgggaaaaagtaaagaataagccagggggaatcagaaaccacacagccccagctagatttcatggctaacgtaaggaagagtttgaaaagaaaaaggacagatccattaatgaggtaacagattattgcctttatgttgggatagaacagggccaggtagaaaaagatgaaagacacacacacacacacacacacacacacacacacacagagcgagctcagtgaattggtcaggtgacacactgatgagggagtcaaaggacactctgtatttgtgctctcaggacacacagtgaacagtgatcatgaaaagcatgtcctcaataattttgcgtaaaatgtggtcaagtttccctgcagttaccatgagaatacagcttttgaggtatggtcaactttcactaggttagtaaatgataagggtaggaagaaatggaaacctaaacatttactctaatgagaaccaaaaagcaatgtagtaggcataattcagacttgtctgacaagacaaaatcattattttcagcatgtactgttttccctggacttggcatctccaggtgtcaacatcaaattaactgtccacaatttctcagactcacctgggacctgttgcctcgtggtcctcctttttcacttgatcccaccgatgtcctgcaaataaattcagatgggccctcttacattaagcagttcttccttgcacacagaaacattcctctgtccaatcctaacacagggacatcagtcttgtcagtgtgagaacaggagactttgagagaaatattccagtaggcctgaggtcaagtcttgagaaaactggcttgggttctttcatgagccttgggcaaaattcccctgtgttggaatgttatcttccctatgtgctctgtcctaggtttatgtacacaaatgagcaattttttccccaataaattgtaggcaaatagttctaacacctcataggagagatacttcaatattaggcttttctcattaaatacccagaatttgatagtttatgagattgtggacacagagatttgatgaaagggtgcaatgtaccagctcttgagtcaaaatgaaacttggttctacacagaagcatcagctattatggcttttgtgggtgaaaagtcagccatttatctagaaaacataccaggaacatgacggacagatgagctaaaacaagcgaacttagaagacacagaaaatgggaataaattcagtgaaacctgggtcacatctttcactgagaggtagacaagggtgacactggccttgggcaggtaaagaaccacacagacatgctttgggaacaaaactcataaggaattttgtagctggcaagagacatttaattcagatgagctgagctgacagacaactcctgggcatgtgctgcatagtttggtgtgagtttgccacacctgccttgagttcaatgtcgtgacagtcagtccaggttggcacgggcatggcctgagactaggaagagagcaaagctcactgacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcactgcctatgtcaacagccatgcagacttgctgttcctctaatgagtgaaatgtgctgctgtaagacttgtacgaggccaacatttcaggaggaattgagagagtcgaataaccttcatcccaggactcctgggggacttcctcctcttcagactcctgcagattcctgatgagccaggcaggacagggatgacagaagatttaaccaacagactttagacaacaaaacctcccagatgatctgatgggagacagaatggagtggtcacagaaaccaaaggcatttttccttcaagaggaataaaactatccttctaaatacagggtggagggtgactgctctggggacagagcaaaaatgggcagcgtgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacgcagtgcagacacagatcttgtgtattaagggccccattttcccaatattttgatataatatatttactttttcaatttcttttcttgcaaaaatactagccaacatactaccaacaaataggaagaaagcatatatacacctctccctggatttaaacacatgggagagaataggcaacaccaagaaatccctgtttgagggtctggagtggacttccagcaaactccaacagacctgaagctgagggacctgactgttagaaggaaaactaacacacagaaaggaatagcatcaacatcaacaaaaaagacatccaccccaaaaccccatctgtaggtcgccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggctaaccagaatgaacagtgtagagaagaccttaaatgacctgatggagctgaaaaccatggcacgagaactatgtgatgcatgcacaagcttcagtagccaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagggcagccagagagaaaggtcggattacccacaaagggaaacccatcagactagcagcagatctcttggcacaaaccctacaagccagaagagagtgggagcaatattcaacattctttttttttttccatatgtatagttttcctttattattttttgtgtgtatgtatatatatatatatatatattttttttaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttcccctttctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagtgccgcaataaacatatgtgtgcatgtgtctttacagcagcatgatttataatcctttgggtatacacccagtaatgggatggctgggtcaaatggtatttctagttctagatccctgaggaattgccacactgccttccacaatcgttgaactagtttacagtcccaccaacagtgtaaaagtgttcctatttctccacatcctctccagcatcttcaacattcttaaagaaaagaattttcaaccaagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaatcggtaccagccactgcaaaaacatgccaaactgtaaagaccattgacactaggaagaaactgcatcaactaacgggcgaaataaccagctaacatcataacgacaggatcaaattcacacataacaatattaaccttaaatgtaaatgggctaaatgccccagttaaaaaacacagaatggcaaattggataaagagtcaagacccatcagtgtgctgtactcaggaaacccatctcacatgcagagacacacataggctcaaaataaagggatggaggaagatctaccaagcaaatggaaaacaaaaaaaaggcaggggttgcaatcctagtctctgataaaacagactttaaaccaacaaagatcaaaagagacaaagaaggccactacataatggtaaagggatcaattcaacaagaagagttaactatcctaaatatatatgcaccctaaacaggagcacccagattcataaagcaagtcctgagagacctacaaagagatttagactccacaaaatcatcatgggagactttaacaccccactgtcaatattaaacagatcaatgagacagaagcttaacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaatcacaacaaactgtcagaccacagtgccatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagatacaacataccagaatctctgggacacatttaaagcaatgtgtagagggaaaattatagcactaaatgcccacaagagaaagcagaaaagacctaaaattgacaccctaacatcacaattaaaataacgagagaagcaaagcaaacaaattcaaaagctagcagaagacaagaagtaactaagatcagagcagaactaaaggagagagagacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggtcctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctaggttgtcctagattaactttggtgagaattagatgaccctgctttccagacccacaggccaaaatctccctctatgtgtagaccataatgccatattccctgcttgagtcaaagttaaacaaaattttttccccaaaaaaatctccaaaaattggtcaaacaattttctaagagtgttgctgcgatatggacttatatcaccaggtaacatggacattaaatgtttagaggcatctatacatgaaacacgactgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgccactgcactccagcctgggtgacagagcaagactccatcgcaaaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttctgtcctgatttcagggtgactgtgcagctaagcaagctgacttaaaggagatccagatgaaagctgagagcagtgaagcctggtgaacaatatttccaaatacaaaggcaaggctgccagcttccttaaacaggcatagaaactccatggacattgttcagggacagatgacttaatcacagatgacaagagatattgaatcgaagctaggaggcctgacagatactgcctgtgcacctcctgcactcaggtgactatgagattgtcacacttgcctggggttgagtaacttgatactggggactggcagacaaagtcatgacattagctgagaaggacaaaaaactccctgatatctgtttagaaacccatcacagttttttattcaaatgaatttgtgtttatagagcctgtcttcagagtttatcttcctcagccaagaaagaggtatgagacacaaggaaaacagaggctacctggaataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggaggttcccattaagagggaacatgcaatcctgttctctctgcaacagagcatggctgccatgggaaccagagaggaagagagcagctgctgttcattgcactggacagataggagctgaggaggatgaagactcagctatccctgtacggtgcagacatgacactcggcacacatagagaaacatgacagctaccgcaccctgtgtctaagctgggttatatttcacatactgtggccaagcgaatgcgggtttttggcccatcatagatgccagagagggtgtgcctcctagatattcctcatatgttaccatccattaattgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggacgttggcagctgtctcccccatcctgccagatctgattcccaggcacaggcttggtgtcctgtcacggtttgcatttcaaacctaattctttctcttagaagcagacaaacttgtcccacagtcctctatgcatcagaagatttcaagcctccaagtggcttctgctgtgttcttcagggacattctatccatggggagtgctccagtctgaagcacttcctaccacaaaacgcccccacataaagtgccttctccaacatcacacggcgagggacttcatctcattttggaaagcagttgtaagtgttcccacatttgaatgcttcagacccttgcaagagacaatttgtctgccacggagagagagaaactcaggaaggacaagtcattcactctctgacagttactaagaacattgtcgaaaagacagcctgggaaccttcattcttagtccagagctcttttcactctaacaagcctgctcccatcccagcctccttcctgtcctttaaaactagatagatgctgcctcttgctccaaagaccaccttccatcaaggaaggagggacacttgcaatactgtgacctccaaccccatgggtttcccatctccgttcttacccaagaagtcctggtcatgtcatggccacataagcttagtggaaaaaaacaccactgatacaactgtcattgtgaaagtatggaggtctggagtctctcataagcctgggattttgggtcatcagggcctatggccaccttacctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgcaacttctcccttaactgggtcagctctcgttcctgagcgtgaaccaggactttatattgcctaaggtgagacggtagagaaaatttaagagtagaaagagttgagtgatccgctcaaatattgcaacagagatttctgagacaatgtcctcaaggagacctcgaagcagaaggtcagcacatgtttaaaggaatgtctgtggccaagagaaagaatagaaaatggtttacaggcttcctctgaatcagagagggctcttgcaagatcctcgatgatgttccattcatctttctcttctgtaaacaaaagtaggtgtcttcctaattccctttcaaaaagacatcctttcagttcctcactctggccatggacatttccatgtgaaaatacacatagtgcatcttgcggccactagatacaaagccatgtacagaaatgaggccaggtgcagatggggcgaattgaaaagaagaaagaagaaaagaatgacagggtcgagaaggcaacattgattgagtgaaagaatgagaagccgcagtcagtcaggaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccatacatttttactatcctcctcctctgtttgataaatatttgtgtgtagcgagcctgccatggcaattcctgcccttcccctggcccagcttagctcttacgtctccccaccgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgagatctttgcactcttcatattctgagaaaagacagacacacctgcctcagtggaaggctggacatgctgctgtggtcattgcctacaggacaggagccaggtccatcccaaggacaaaactctccccagtaccagggtctagacagggatttccacatctttactcttcagtctcctgactttctggcatctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaagaggtggaggaggagggggaggtcggctttccatttccagatgtgaccgcccagctgctgctcgccgctgctggattccagtttcctccccttctggcgacggattggtgatgacaccgagtctcactttctccttcccccgccgggaccaaccgccgtggggggccgagggtgccggggacggccggagagcgatcacgggctgggcggcggaagccgacgaggggcgagccccgctccggctcaagcgatcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccgtcacttttatgaattcgactccactttctaaaggaattatgagtcttgtggcaaacacaaaccggagtggccgggagggggaaaaggggggaaaagaaaatctttaaaaattaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttgttgatcttttctccgctgagaaggctcccgccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctcaccgtgacaacatgatgttcagcacggtaggaatgactgccatctctgaaggagtcttaagattctgtagaatcagtgaaagattctatgttctaacgcctttacctttcaggaaagaaattacaaaatagtttcattgtccagtcatattcactatgagttataagaggaaacattctatctagaattagaaataccatttgacccagccatcccattactgggtatgtacccaaaggactataaatcatgctgctataaagacacatgcacacgtatgtctattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatagatgaaattggaaatcatcattctcagtaaactatcgcaagaacaaaaaaccaaacaccgcatattctcacttataggtgggaattgaacaatgagaacacatggacacaggaaggggaacatcacactctggggactgttgtgggttggggggaggggggagggatatcactgggagatatacctaatgctagatgacgagttagtgggtgcagcgcaccagcatggcacatgtatgcatatgtaactaacctgcacattgtgcacatgtaccctaaaacttaaagtataataataataaatttaaaaaaaagaacaaaacatcacattgtaccacataaaaaaaaaaaagttggattttgcaaggaagatagacatctgactaaagtttggcctagcaaggaatctttgttagtactacttcttgtttaaggaaagaagagacactcatctttccttcaaacaatataagtctcttttcttgtttgatcaccttttattcattaaggaccagttgaatcatcagttgggacttggtagcagaggatatttcctggatagtgtgagctatcaggcctttaatgtgggaagtttagtttctataaaaataaaattaaaaaagattaatagttggaacaaactataaagacagtttctgagcccagagggcagctgatcaataagatttctagatgctgggcttgtagtatcttcagctggagtgagaagaggcattggattagtttgcagtttgaatgccataaagatgggccacacacaagctgttgtggtaatttttctgaagcttatgtcaagtcatccagtttcagtttgaaggacttcaagaaatgaaaagtttataattttagtgattccaagccagaatagcaggaaaaaaatgaaatattaatttggagtgttgtagctaaatattgtagtaagctagaaaaattgaggatctattgcagattgcaggcagataataaaacctcaggaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactggttttgtacacaagtgcagttaagagtagtgattgaccatttaggctcttttaaaggttgcgtttgtcagataagaaatctcagattaaactttttgtttttgtttttttagacagagtctccctctgtctctcaggctggagtgcagtggtgcgatcttggctcactgcaatctccgcctcctgggttcaagcgattcttctgctcagcctcccgagtagctgggattataggtgcgtgccactatgcctggctcattttttgtatttttagtagagacagggctttcaccatattggtcaggctggtcttgaactcctgacctcgtcatccacctgacttggcctcccaaagtgctgggattacaggcgtgagccactgtctccagtcagattaaacttttaaaagccacctgaggctgggatacaagcccaaaacttgtcattagtctgcacctgttacatttatagatttagataaatttctctcttcttgaggtccctaaaatatcccaaggtttccagacccaccaagcagtgacattctttacttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatacattgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaactcattttaaaaattattctcatcagttcattcagtaccatgtaattaaatcttgttttgcttgatcttgggttagtagttacatgaacccatcagttttattagagttctggaaattcttaccagtccaattgtatgacgttaaagttgttcagaaacctgtattccagaatagtcataagagtattttccataaatctccttgaagaagaagccattttggactgtagctaatttcaaatgcttttagagaacaattaaattaaaacaataactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaaaaaaattctttgtggctttctgagggtccaatatggagaatcctaagttaatttgaggtcaaaaagacttaacttagaatgtgattttgggaagattgtcaaaaatgtcaaaaagtttaaaacatttaaaacaaatatgaccatagttatctatttaataaaagctccattaaaagattttaaaggcaaattcagattacatagttgtgaacaagaacttagctcctttaatattgagaagactcacttttcttaagtaaccaaaaacctaataaaacaacatgaaactcaagaaattatcttgatgaaacagagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagacatcttttcttatttacttttgcaacagacatacaccagacaattaagcaatttacttttactacatattctactcttaggttgaatttatggttttatggccttaaacatctaacagtaacaacacaaacttgtctaatcagcaaagccaggtaaaacaagtgtatgctgacaattctgaaaatgtttctatttttattttaccaatattttttaaactagtttttatttactaaggaatatcccagattatgtgaacttaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagagtgatgtaaccagatcttatgacttctcatttaaaaaattttaaccaggccaggtgcagtggctcatgcctgtaatcccagcactttgggaggctgaggtgggtggatcacctgaggtcaggagttcgagaccagcctggccaacatggcataaccccgtctctactaaaaatacaaaaattagctgggcgtggggcatggtggcgcccggctgaggcacaagaagcacttgaacccaggaggtggaggttgcagtgagccgagattgccccgctgcactccagcctgagcaatgaagtgagactctgtcccaaaaaaaaaaaaaaaaaaaaaaaagtttttaaccatgaggcagtaaaacagagtaatacaaaaatacaaactcactggtttatctccgctttatattgttatccaaattgtgtttctggtgaaaaagggataagttgagttgacctacataacaaaggctaaagctttttaccaatatttgtggaggaggttttttaagatttttttttttttttactttatcagtttccaaacagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagcccagggaatcagggaataacccctcactcagaaaaagagagccagaaagaagagacttctagcctagggactcagagaatagaccactcagaacaagaagcccacacgaagaccttcctgcccagaggattgctttcaaaagaagcctgggactctaccccagcttcagagagaatattcatcccttcagattcaaaatctgtccttagccatcaacgggcttttgtctggagcaatggctcaggaatctgattcaccaatggatccctaatcagtcagaaatgacaacaaagacttcaaaggcatgcatttagggttctgagtgagaggcccaggatccagtgatgaatctgtcctagttgagtttcaacaccatagttgttaaagaaaaaattattcagtgatacttcaaatgcacagtaaagaagactttattcaggaccatcaccatagatataggaaccactgcaacacagtcttggagctggggagagagatgggcttaactctgaatacagcatgcggaagtgggaatttatagcccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgaggggttctttggtaaacttggcagtgttctttgctaatgctggattttgcgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgccttaaccaaaatccagccattctagaaagacaccagaaggctttctgcagcatctaaaattccccacattctgggcccaaatccttttcctttccctgttgcttttagatccacattgtgtaaccctcatctggaaacctcagtttcttggagtcatttttttttggggggacggagtttccgctcttgttgcccaggctggagtgcagtggcatgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagatgatccacctgcctcagcctcccaaagtgctgggattataggcgtgagccactgagccaggccattctgtctttttatataatgtaacttgtacttttatgtagtaaattatcacaatggtgtcagacactctgaggaagagtattttactgtatcattcccattacccaatcaggaagtcttaacaggcagattttaacaaaaatataagacacaactgtgccctagcttttctcacatacttcctacctcacacttcacacatttctttttctcagcacccactcttaagtaataatttatttcccctgaatattatttaccttctgtgggctactttacatatcatctgaaagcatgatcaaaacagttatatttgtgaataattttattttggtttatttcttagcagaaggaggagttaatagtaacatttgtaggccgggcacggtggctcacacctgtaatcccaacactttgggaggccgaggcttgcggatcatgaggtcaggagatcgagaccatcctggctaacacggtgaaactctgtctctactaaaatacaaaaaaattagccgggcgtggtggcgggcacctgtagtcccagctacttgggaggctgaggcaacagaatggcgtgaacccaggaggtggagcttgcagtagccgagatcgcgccactgggctccagcctgggagacagagcgagactccatctcaaaaaaaaaaaaaaaaaaaaaaggaacatttgtaatctcccagagattgccaaggaaaacattctcctggctgaatttatgtagagttcatcatctaagcataaaatattttataaaggaatgggccaatcaaataactgctatgcggttgacaccataaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacggaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatctctccatagatgtctggaaacagcttaattctgttaactgctgcccattgaattatgctttatttggtcgtagaatttcatgtcatctgttagtctccctcacaacttgggagatgttattcctgtattgtctgttctcgttgatgaagagaagtctgtgataaagtaattgtccttcctttgcaggtaatctgccttccgtctctggttgatttgaaaatattgtattagtctttagtatcttgcattttactgtggtatgtctacataaggatttatacttactgagtttgctcagagcttggagtatttcctcagtcttaaaggccctagttgtgaaaatgttactacagaaaaactttctttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctcaatatatatcccaattttcggtctttagatctaaatctttcagcaacctggactatcatggccccagtgtaatgcttggctttgtacctcatgagggaagaaatttttttttttaatcttaagttctagggtacgtgtgcaccacatgcaggtttgttacataggtatacatgttgccatgttggtttgctgtacccatcaacttgtcatttacattaggtatttctcctgatgctatctgtcctccagccccccaccccctgaaaggccccagtgtgtgatgttccccaccctgtgtccatgcattctcattgttcaactcccatctgtgagtgagaacatgcggtgtttggttttctgtccttgtgatagtttgctgagaatgatggtttccagcttcatccatgtccttgcaaaggacatgaacttatctttttttatggcttcatagtattccatggcacatatgtgccacatttttttaatccagtctattattgatggacatttgggttggttccaagtctttcctattgtgaatagcaccacaattaacatacgtgtgcatgtatacatctttatagtagcatgatgtataatccttcgggtatacacccagtaatgggatcgctgggtcaaatggtatttctagttctagatccttgaggaatcaccacactgctttccacaatggttgaactaatctatgctcccaccagcagtgtaaaagcattcctatttctccacatcctctccagtatctgttgtttcctgactttttaatgatcatcattctaactggcatgtgatggtatctcattgtggttttgatatgcatttctctgatgaccagagataatgagcattttttatgtgtctgttggctgcataaatgtcttcttttgagaagtgtctgttcatattctttgcccactttttgatggggttgtttttttcttgtaaatttgttgaagttctttgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctggtcatgaagtctttgcccgtgcctatgtcttgaatggtattgcctaggttttcttctagggttttttatggtgttaggtctttcatttaagtctttaatccatcttgagttaatttttgtgtatggtgtaagaaagggatccagtttcagctttctacatatggctagccagttttcccagcaccgtttattaaacaggggatcctttgagggaagaaaattatttctaatattttaatccagctatgtatgtaaaaagaagtctttttcatattttatctattatttctgtatgattggagtatgagtcaaaacatctcaatataaataaaaagttacatttcagtaatttttttttctaaaattacaaaacactagtggtcaaaaacactactatttccaattctctttactttgttaacattactttttgtacttatgagagaagagtttgcaatccaaaaagagcaggaaggaagagagattagagattttttctcccgcttgctctatacatatgagatatttatatatctatatatcaacagttgacctttgaataacactggtttaaactgtgtgagtccacttataggtggattttttcagccaaatacagattgaaaatatagtatttgtgggacgtgaaacccacatatgtggagggccaacttttcatatgcgagctctgcaaggttgactgtgggacctgagtatgtgcagacttcggtatatgcagggctcctgaatgcaataccccactaatactgagggatgactgtatatgtctctatctatctactctatcatatatatatatatatatatatatatatatacgcacacacacacacacacacacaaatatgtgtatatatatatgtatgtgtgtatatatatatatatatatacttcctatattactttgctagggttgttataacaattactgcagactggatgagttaaacaacagaaatttattttctcacggttctggaggctagaagtgtgaggtcaaggcatcagatgtgttaattttattctgaaatttctctccttggcttttagatagtcattttctcatcttgtcttctcatggacttttttctgtgcacatgtatgtctgtacctaaatttcctcttcaaataaggacaccagtgatattggattaggacccagacatgtgacctcattttacattagttacctcttaaaagtctctatctccaaatatagccaccttctgatataccgggatggcagggggcagggtacagcatattaatttggggaaaggacacaattcagcctataacatatgcaatatattcttctctgatctatattatataacttttacatataatacatatataatttaatatacattttaaccccttgattaattttctcactgcagagaaaacaagaattaaagaaaagcttcaggtgataccatttttgaatgagtaagaattgagcctacccttaacgcaagaatgaagtagaaataaactgacttagggaacagcataaaaaagttctcttatgagtcaagatttcagtgtgatgtcatcattttttccagggattaaatgttagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctctctgtaatatcttgtttccaaatgaggctcacattgaattttctcttgttagaaatataactggcaacaccaatcaaaaccattcattccattcagttgcctgtgaacaagcttgatttgctttgttattaatacagcttcttgtggtttaagtagaaagctcttttgtaaatatccctcagtttaagtatatatggtttacatttccaggtaaactataaattatctgagaaaggcccagcacggtggttcaagcctataatcccagctctttgggagtctgagatgggtggatcactggaggtcaggagtttcagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccagcctgggtgacaagctggactctgtctcaaaaaaaaaaaaaaaaaattctgtgaaaagatctgtgatttccattctcctttatagtaattgttaagcactcacaattagatggttataacaactatcaaagaaaaacaattattttaataaatatttttcaacattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagatagggataataaatagaacttatctcataaaattactgtgaggattataagtgattatgaagttgattaaatttccccagtgcttcatacaaagaaaggactcaaaggatatgctagttcatagtaggggcatagaagaagatatcccttctctcctgggatatagggtatacttaactgtccactataaaattgaagataggctagagaaaagctaaaaatgaagaatctaataactctttagccaagagaaaatgaaacatgagggaaagggagaagttccaaatgaggtccacatttgtcgtgggccactgaatggtggtgccattcaggcagaggaaacccagaaggaggagtcattctgtagttagagggcacttaatgagataatattagagataactgaggttgagttgttggtacatatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacagaaaggacacattttcaagaaagacattgtcaatagtttaaatgtcacaaaatagtagagtataatgcaattaaaaaaacaaaatctgttgcttttgttaattaaataactagtaacctcggctgcagcagtttcagtagagtgaggagagttgacaccaaactgcaccagtggagtgaaaataagtgggaagaaagagtgaggaagtggaggacagtcttttttttttttttaataaaatattttcccaaactgtcttttctggaacttccaacatgtctgcttaagagcttgtctaagttgaattcattcgaacttcttgaacctaattagtttctttttgctgttttttttttttttttttttttttttttgagatggagccttgctctatcacccaggctggagttcaatggtgcaatttcggctcactgcaacctcctcctcctgggttcaagcagttctcctgcctcagcccaattagttttaaagacgctgcatatattggcagggaaaacctagaacacaaagtcaaacttccaattatctcccttcagtgctcaaatcaagagttcatttgttgcaaggaatgggggtctggactccagggagaagaatagagttttagaaggagagttatcctaaaactaaatggaaggagggttctttgagataccaaggatttgcaggactttatttacaattaaatgttagtttcagacagcccaggaggaataggtctattaaaagaaagcaagagtagttggcataaggaaacaatttgcattggagcctgagagtgagtatagtaatgaccacatgagagacccatttgactcaagtacttcaaagcattgccagtgttagtctttgctccacaatcaagtggggaaaaagtgaaatgtctttgaagagcatttcctgtaggtggcctttgaggaggtcctgaaaattccaaacctgcaagtattaatggcaaagaataaaaatttctttatgtaaaatacttttaaaaatctttctaaatagcaagacattatatattaccattgttaaaagataaacgaattgagaaatatcattagaattatatgcagcagataaaatggtcactttttcttttgagacggagtctcgctctgtcgccaggctggagcacagtggcatgatcttggctcattacaacctccaactccctggttcaagtgattcttctgcctcagcctcccgagtagctgggattacaggcacgtgccaccaccccagccaatttttgtatttttagcagagacggggtttcaccatgttgggcaggatggtcttgatctcctgaccttgtgatccacccgccttggcctcccaaagtgttgggattacaggcgtgagccactgcgcccagccaaaaggtcactttttaaacttaaaaattattaagaaaacagtgaaaacttaatgtttaaaagagtagaagatagggaaaattattacacagaaaaagataaacaacagagaaagataaataaattgccagtgaatatgtaaaaagttgctcagcaccagtggtagttcaaatccaaatagcactgagttagcatttgttaactaataaattggcaaaaattatattttgataaaacccagtgttgttgacatcccaagaaaaagggctatgctcacacagccttggagcatgtgcacattgatgatttttttggcataaaaattagtggtttctattaaaatcagcagtgtaattcacaatcgctaagacatggaatcaacctaggtgcccatcaactgtggattggataaagaaaatatggtacatatatgtcatggaatactttgcagccataaaaaagaataaaatcatgtcctttacagcaacatggatgcaactcgatgccattatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaacaactactatgcctagtacctgagtgatcggatcaatcatgccgcaaacctcagcattacacaacatacccatgtaacaaacctgcacatgtacccactgtatctaaaatcaaaagttgaaattataaaaaataaaaaaataaaatcaacaatgtatatttctctcacacagccatcacgatgatgtatttggaataatatatgcataaggatgttcattgcagtgttgtctgcaaggacaaagtgaaaacaatctgaataaccaacaatatgacacagagtaagtaattattggtacgtctgtacaatgcctcatgcaatcaccactgacagcatgggaaagagagacatctattatgaaaagaccactaagacatatgattacatgataagtgcaaggttcatgaataaatagtatgtatactagtatagcatacttctttctaagaaagaaactataacacatacaagaatggacaagaagttattaacaatagctaactttggtgataagactgtaggttgtaaaaagccagactttcatttctcattttaaacccaatgaattatttaaatctaaccctactgcattcattatctttacaataaaataaatatgtataacaatgaaacatagtttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactgctaactcttctctttggcagatcaaatgcttcttcttaaaaaaattaagtttttggtgtcgggagcgcgcggcgccccggctcccgcccgctcccagccgggcccctcagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagtggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccaccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccacgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccattttttggtgtgtttatggaagtgcatgtagagcatcctgccctttgaaatcagactgggtgtgtgtcttccctggacatcactgcctctccaggtcattctcaggcccgggggtctccttccctcaggcagctccagtggtgggttctgaagggtgctttcaaaacagggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggttggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagactcttgagaaattgttactcattgaactggagcatcaagacatctcatggaaatggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaataatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtctgtggttcagagtaaacttgaagcagatctctgcatgcttttcctctgcaacaattggctcatttctcttttttgttctcttttgataggatcctgtttcctatgtgtgcaaaataaaaataaatttgggcaaaaaaaaaaaaaaattaagtttttaaaatgtatttcataggatttttgttctctctctccctctttttgtgcatatgtgtgtgtgtctgattagtctttactatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctccagttcaaagatgcttccaatagttgacatggcccttcattccttaaaaccagctatttttcttttgaattacattacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaatgaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataactttgagttgagagccaaattttttgaaggtaaaccatctccctgttttaaagtagtgtttaaaattataaaaattttaatacatctgtaatataaaatatttagatataaatactacaagtgcaaatgaatttttttttctacttctgcattcaacttttctcttctcccttcagggaaaacacttttgtgtaaaggcctccaaaatatatgtagaggtgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacaccaagatctactcctctgattttgttctagcattatcttaatggaaatgtttactgaaatggaaatacatgtagtggacatcgtggtggtgtctcaagcattcagtgttccctgctctcacacactcctaaccaaataatgaatttctcagcttcacaatgtttaagtgacatgagtcccatgcccaattcttggtcattgtaattggtgcatggaaggaacctgtgccttctgctaatcaaatcagaatgaagtacaactttttcattccatgattgaagagggaaatgccttctttccaaatgcagcagaggaagcatgaggtactaggattggaagttgtctactcatgacatgatattttaagccatagaataaaactgagacctaatgtgttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgtcctcacatggtggaaggggcaaggaagttctctaaggtctcttttataagggcactaatcccattcatgagggctctgtcctcatgacctaatcaccccccgaagacccactgccaaatatcatcacactagggattagatttaaacatacaaattttgggggggatacaaacattcaatctatatcacttaaggtagagtgaagaaacagggaggacaagaagcatttattttgtgtcattattaaacttctgcattaggctatcttgagcctatactattgttcaaaatctctttattatacaagccattttgaattttgattgtttgcaaccaaaattaacctaataagttaaaatgtactataatgttacatcataatttgtctgtactagtagtatttgctagagtgtttaggggaatacttgcttgttaactttttagtaaatataacactccatgttcaaatacatttgggaaatgctgagcatttcacacttttagagactcaaaacaggcagcacatttttaaaaaataaaaataaaaccaaatagcattgcatttggagaatggtacaaaaaaagagaatttgataaaccagagttatcagaactcagtggatactatgtgttagacattattataagccattaaacattttacaagcttgatacctgagttaaaaattaataacccaaagacacattggaagagaaaagttgacatatttttattatattaatgacctaaagatatcatagcaactaacctcattatagtcaacaagtgaatgaacgtaaataatattaaataactattggaaagtctctctgattaagcatggaaataaataggcagtgcttttgaccaataaatggaggacttacaatattttccaatacgaaacaaaaagattctaaatgtaaaggttttaggcccaaaatatgttagtcaattcatgacagcagaaattcagcaggtcatatttttggggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggattgaggcaaaaaccctgaattataccaatattatctttttttttattatttttattttgagagaggatcttgctctgttacccaggctggagtgcagtggtgcaatcatagttcactgcaaccgcgacctcctaggctcaagagatcctcccacctcagcctcttgagtatctgggactacagaccctcatcaccacaacacccgtctaatttatctattttttgtaaagatgaggtctcactttgttgctcaggctgacaagtattatcttaatgttatagaagaaaagtaattctggccatatataggtattattctttgcagtggaatatcatttcagaaatttgtgccaaacataaaattagttttctagtagtaaaaagtaattaaactctttaaattattattacccctagtatactggggaatgagtgtgtgttccaaatgaaaaaaacttgggatgtctaatgagatgctgttttctgtcgcagaaaatctatgtaaaatgttttttctcacgtgtacactgttgatatttgagacagcacatgttaacacttcaagaagtaaaataaatgtgttgattatatccacagttttcatatttattaactatatattttgtttttaatgtaatgcctattgaaaaacctgtaaatagttgtttcttaaaattgataaatactgcctaagatttttctgtatattttcatatttcaattttcctgtgaggttagaatgaacacttttagctaagacatttgggcctccaaatcctaaacctttcagaatgttagtttattatttggtttttacctaaattattttctgcttattcaagatccttaggtctatccagttacgtttttatttttttatttttatttttttattttgaaacaaagtctcactctgttgccaaagctggagtgcattggcatgatctgggctcactgcaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcgtgagccaccatgcctggctgtatccagttacatttttaagaccagccaggcttaatatatatttggtctttagctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagagagccagatcaaagctaggcagccaggaaatgtaccccaaaccatgctgtagaactcatccagggaggaaaccactgtcaccaccagtaagaagtaacaccgaagatgcagagagcaacaattgcagcaattgctcaatcctaggctaactgcaaagccaccagcaccactcccacttgttcgctttgcaacagatagctgcaaaggaggctgagaaagcaagcatttgacattttagcttctaaagcaggaggtggtttcttgttttcgtcaaaactgagaggctgaggaattcctcaaacacaggaacaaacatcaaatagtaaatattcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacaaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtaaaggctctcctttctgcaagtggccagcaggtcactattggcatctatggccatgtgccctcagctaacacctctgctagtcagggttttgccttgtgaaatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagagttcactctttgtgtggtacaggtctaggagttttgcaaaacgcataatgtcatgtacccatcattacattattaccaacgtattttcaatcccctaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccgtggcttccacaatattcacacgttctttcaccttgccaaacgccacatgcttgccatccaaccactcagtcttggcagcgcagatgaaaaactgggaaccatttgtgttgggtccagcatttgccatggacaagatgccagaacctgtatgctttcggatgaggttctcatcatcaaatttctccccatagatggacttgtcaccggtgccattagggcgtgtgaagtcaccaccctgacacataaaccctggaataattctgtgaaagcaggaacccttataacgaaatcctttctctccagtgctcagagcacgaaagttttctgctgtctttggaatcttgtctgcaaacagtttgatggagatgcggcccaagggcttgccatccctggtgatttcaaaaaagacgacggagttgaccatggctgatagtacagggctcacagcgatggtggcgtctgcaaagataaccactgatcttttcactgtctttatagtttggccttttccagagtgttgtatagttgaaatcacagtatgtacccttttcagactggcttctttcacttagcaaaatgtctttgtttttctgtatctttttgtggcttgatagttttttccttttagcactgaataatattccactgtaggaatataccacattttgcttatgcagtcacctattgaaggacatcttggttgcttccaagttgtggcagtcttcatttctttctttctttctttctttctttctttctttctttctttctttctttctttctttcttcttctttttttttttttttttttgagacagagtcttgctctgtcacccaggctggagtgaagtggcacaatctcagctcattgcaacctccgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgccacagtgtagccgcattttaaattttaaatttttgactgtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacattcataacaaatatcaaagattgttgtattttttatataggagacaccagacaagcttatacttagttactagttcagaggatacaccaccacatcctctagcatgagtacaaccttataagccattgtctccagctggcactgtgattgagtctttaataaaatattcaccattctgtaataataataattttggttagtgataggataaatggtggaccaggtgagtccaatgaatatctactcatttgttatacaacaagttcttttaagagaaggatgtagaacaggatattatggcagtatatataaggcattcaatgtacccgtggagagtggcgatcagagaaaaatgatgtcaggtaaagcaaatgtaattcaaggttaaaggtagattccatttacaaaattccttgttgcctttatcatagaggagttccaataaaatcaacaagtctgacaaaaggtgactggtttattcacccaggatatgttattgtgtgcttagccttggactttgttgcttgtgtgttggacacctaatagtcttgacagctaaataggcttttgtaagcgagagtggtaaagtccaacatgttgctgaacctatgtgtattctctactgctaccaccaatgttgctgtttattagccttctaagcaagcaatgtagtgcctggtgaaagagattgtttcataccttcatatctatttgataaccttcctgatgatagtttggtgagcattcgtattaagcacaaatattcttacactctggctcattttctgtggttcatctacatattttttccccaaaactcattgccaccaatccttcagtctttgtctttccgagtccctaattatcttttcttttctttttttttttttttttttgagacagagtttcgctttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgagccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgctgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaatgcattttgttccaaatcctaagaacaatagtagtggtgtgtcagaggctctattgcatctggatataaaaacaaaggggcacaatattcctgaccagttgggaattattatcttcatctcaatcccatcaaaatgtggcagcatgacaagtcatgaagtaaaaggaccaggtgataaaatgaggtctccaaaatccaaagcatcaaagttctcagttagtggtcagggctgcaaagtgccataattttgcactttggaaggtatatcttgagaatattgagtgtatgagacaagttaaaaggtcatgcagccagacgcggtggctcacgcctgtaatcccagcacttagggaagctgaggtgggcggatcatgagatcaggagttcaagaccagcctggccaatatggtgaaaccacatctctactaaaaatacaaaaattagtggggcatcgtggtgccctcctgcagtcccagctacttgggaggctgaggcagcagaatcgcttgaaccctgaaggcgaaggttgcagtgagctgagttggcgtgactgcatccagccttggcaacactgcgagactctgtctcttaaaaaaactaaaaaaataaaaataaaaaaaatttaaaagttcgtgattaacacctctgttagcctctgatctttataataattatcacacacacacaaaccaaacaccacacatagaggaaacagtaaaagattaaaggacacagctaaaaatacatttgtattattacttcccaaagttctaaaattatcagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaaacaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatatttattatttgtataatacatattatatatttattatatattatatttatattgattatatataatatatatatatttattattatatatttttttgagacggagttttgcttttgttgcccaggctggagtgcaatggcgctatctcggctcaccacaacctctgcctcccaggttcaagtgattctcctgcctcagcgtcctgagtagctgggattacaggcatgtgccaccacgcctggttaattttgtatttttaatagagaaggggtttctccatgttagtcaggctggtattgaactcccatcctcaggtgatctgcctgcctcggcctcccaaagtgctgggattataggtgtgagccaacgtgcccagccaactatgtaatattttaattgtgtagtgataaccctcatcaaaagaagtattcattatggtcagtgtactctgcttatttaccactgaagcttaacacaaaattgttgaaataaacatgcatattgaagtacttagctagctattgaggcaatacaggtttctagatttactcatttttttcactgtacacacatgtcgtgtgtgtcatgataaacccatgtgtgtgcatatattgattaaatattatatttctttttacttttattattattattgagaaaagatctcactctgtcgcccaggctggagtgcagcggcacaatctcggctgcctgcagccttgtcctcccaaagccctagaccctgtaacataatggaatatgtatgtttctaatttgtgcaatatggaagcaggaatactacatagaactgtcatcttttcctattgcatttattttggtgtggaaaaatataataattggcttcagtcagtaagtctatttcattcaagaatatttaaatataatccaaaccatcttaggtacattttgtgatacaagaggatggtatcttctatttggaaatataaaatcccagggtctcacagtttaagtatactttccatgggtatgtataaaacaagaatcccactttacaaagttaatagaaaaaatatatgctaattggaaggagaggcttctgattgaggataaagtggaaattttcacatactgctaattacactttaatggagtaagaaaaaaagaattggaaatagtaccctataaaacttctgaaatgaaattacagtttctctctctctcttttttttttttttttcttgagacggagtttcgctcttgttgcccaggcgagagtgcaatggcgctatctcagcacactgcaaccttcacctcccgggtttaagtgattcttttgcctcagcctcccaagtagctgggattacaggcatgcaccaccatgcccagctaattttttgtatttttagtgacccaccacgcctggctgtctcctctttttagaattaggagaactgatttttttcagtgctaaactggcactgtcctatgttttcaagaaagcaatatggtgaaacgaaagagcctggatagcatgttttgttagctggcgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttcatcttggtctctgtcatttccattttaaactgggactgaataacctgttttaccactcaaaataatagccagtgtctctttcttattaaaatatgtgatcttttgcttgattacctaattatgtcacctgcaccttacatgaggcagatagaagagtcttccagtctgccagagcagatctaccaaactagactgcacatacaaattacctggggatcctgataaattacagattctgagtctgctttcaaacagggcctcaagtcaagctgatggtattagtcccaggatccctcactgagtagcaaggtcttacaattaaaaagtgtgcaagtataaggccgggagcagtggctcatgcctgtaatcccagcactttgggaggccaaggcgggtggatcacctgaggtcaggagttcgagaccagcctggccaacatggtgaaaccccgtctctactaaaaatacaaaaaaattagccaggtgtggtggcacgcacctgtaatcccagctactcagaaggctgaggcagaagaattgcttgaacctgggaggtggaggttgcagtgagtcaagatcacgccactacactccagcctgggctccagcctgggcaacaacagcaaaactccataaaaaaaaaaaaaaagtgcaagtttataaacatggaaacgtggacaattgtaagcaatattagagaactgtagaaaacaattttttaagtgatatgtttaacctatttagaataaaacccattatggtcctaggaatttctggaactgccttacttgtgagaaacatgatcctaagatgcccatttgtttatcagtacatcaattttctccttcttgaattggtatcattattttcttccaagaagcctagcacacttttgttgttgtcattgaaagagggcatataagggttatggctgctatttggagaaatgcattagaaaataaaaagcttgaaaaagttgtattactgagaaaaaagttgaatgaaaataagaaagattaaattgaaataaataatgaatcagtaaggtatgcactgttaaacacttgatgggatttcccaagtatcgacatgctgataacttgaaataagaatgggagaaaaggtcaatctgaattcttaaaatgttgaaggctgggaataagaagtaatatatcacagaatctgatagaaaaatttttatttattttatgggagaaatgggagactaacagacaataggaataggaaagaattaatagaaatagcaaaaagaagtgtatctgcaattattaatataatacaagaggacattgtgtagagatatttaaagaaagattgatgaaatttagatttatggagaaatatcctaataaagacattatttataatcaactgttcatcattattatataattctgacagtttttaggttataaatgtaaggcagaatgatctaatataaaatgtataaatgggacaacatataattttgcttaggaagttgaataaataaagtagtgatttacaatttgcattaatataaaaaaatttaaaaaatggtttacattttgtttgaaatggatgataaacaggaaaagagtaatttagtacattgagtaatttagtacattggtcaccaaagaaatacaaattgaaactataagatgccttctcccatctttgtcagatttgtaggtataaaaacagtagtagttgtattcgttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaactagttaaatatacaatcacaatgagctatgacaaaatgcagttacttaaaagcacatttataaaactattaatggcaataaacatgatttaatataatgttttcaaaaattaggggaattctattcccagcattgtggtagactaaatttgctgaatcactatgctgctatatgaaatctacaaataccagataaaatgtacatgtcatttttcaaaagtatattactgacttgaatagaaactaaggtgaaccacataggccaagcataaggagaatacataaatccagagaggtatgcagacccccaaaccagaagcttccataaggacagtcctggtcctagtaccctgagcttcaatttttatgaccacctgggatatgggagagtgtgagacaaaacctagtgcctgcccagtatagcagtcttacaggagaaaactgctgaaagccacagatacgaaggactataatttcagggaaaggataaactagataaaaacctgttcctcagggggagacaaccaggaaattttcctgcctcaaactcggtgctatttagaggaaaaatgagaaggccatcttcacatgaatttgtggtttaaattttcactgtaagtataagttaaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggacgattatataactataaaagctgtgtttaatatgtttaaaaaatcaatgaggtgtgccaggaatataaattgagacagtgtatgtatcttatattaagcagattgaaactgaatttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggatatgtgaaatagaggttgaaaaattagagtatctaatcatatctgcaaaagaaaaattgaattgagggaaggttatatttaaggttatatttaatatctgagggcttttcgtcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaatggattatttccattttataaaaacaactccagaataaaaaaaggtccatttgttcgttcattttatgaggccagtacaaccttgataccaatgttatatgagaaatgtgtaagacaggaaaattacatgccaactttcctcatgaacctaacggcaaacattttaaattaaaagttagcaaattaagtttagaagtctataaaaaatatagtatgaaaattgtgtttgttccatgaatgcaaggatttctaacaatagaaaaaaaaaactatgtataattcatcacattaacaagttaaaggaggaaaagcaaatcatcattgtaggagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagcccatatttaatatatttatatattaaatatttaattatacttcaaaacttttatgtacactataatctcattattgttttctatactattatatgcaatatacaaatacagaaatacagaaatgtacctcagtttgaaagagaatttgaatatgaggcaaaaagatacccccaaattatagttacattacaagaattgaatttaagaaggaagaagcaaattgcaagagataaggccaagcctctttagtaatgatcattctaaatccaattggtataaatttaggaacgcacaactggattgcagtgtaactaagaaagtttgtgtgtcaataaccatatttatcctatgtgaagaaataatagtttcataggagaaggttaattggcatggagtctgtaaaagagaagtttggatagatgattgagctatgtatttgtcaaataatatctaaaggtaaaaagagatctagttcacagaggcgaatctctgattttttaatttgcattaacagaaacaacattggaagggagtatattaagattttaatagtgactatttctgccaatggtttctgttttattgtttactatttttggtatatttccaatgtttcttaataagtgtttattatttaaaaaatgagaaaacagcaatgagtaattcagtaaaataacatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaaccctacagggatttatttcctaactatgaatttctatcttggtctagagacgactgttctcataaataggtagaatagatgtggtatttctggaatgagatttaacatctttacgtagcttgccctattaaaagtagacaaatgcttgtgagagaatatcatatacttttgaaagctaatgtcttaactaattcgctgtgagcaaagctcttgaagactgtgatgtaacagagattcctaggtatcagtgaagatacggagatgaaaaagggaagttgaaaaaagaagctgagagataagcatggaaatcattttccaaactcatttttccaatctccattttcctgtattgagaagtgaaaatatgttttctagagataaagttctagaaatgaactctgacatagatattttaaaacccatttcagaaacaaaataatatgtgaacctagagtagttgtaatttatgtccttttgtctgtctttatcctgtagttaagtttcccttgggatctctttgggaaaatggagtactgcattttacaaggcaggacttgaattttcgttcttttccttctttctctctctctttctttctttccttttcttctttcttctttctctctttttctttctttcttcctttctttccttcctttttcttttctttctttctctctttctttcttcctctctctctttttctcttctttctttctttctttgttcctttcttctttctttcttcttttccttccttccttccttccttccttcctcttcttcctttctttctcctttcttttttttttttttttgacatgatctcactttgtcacccaggctagagtgcagtgatgtgatcatagcttaatgcagcctctctctcctgggctcaagcaaacctcccacctcagcttccagagtacctggggctacagctgcgtgccaccatgcccagctaaaggacttgaattttcttacatatcttggccctatagagtggttctcaacctcggctgcacatgtctattacctgagaaaagttttaaataacctaatactcaggtcacaccctagactttaggggtgagacaagcattaatatttttttaacactcttagaattaagagccactaatattgtagcactgcaattcctataaagagaacagatgtgagtcgatttgttacagtattgttgtattcatctgttttcatgctgctgataaagacatacctgagaccaggcaatttacaaaagaaagaggtttaatggacttacagttccacatgggtggggaggcctcacaatcatggtggaggacaaagaggagcaagtcacatcttacatggatggcagcaggcaaagagacagcttgtgcagggaaactcccattttaaaaatgatcagatctcatgagacttactcactaacacaagaacagcacaggaaagacccatcctcatgattcagttatctcccactgggcccctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaaggcaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcagtgagactgattaataaccatgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatacctttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttgtctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtatctttttaaaaatgaccttaatacacatcccccatatagaatatagctcttaaacaagttagaaaataaaattttatcttttagtattacacaaaaggatgttcagaactaggctttgtattttttttttctagagatgaggtctcaccgtgttgcccaggttggtctcaaactcctgggctcaagcaatcctcccgcctcagtctccaaaagtgttgtgattacaagcatgagatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccatgtgataaattccaacctgagaagttgctatagaacatatgaatttaacattttttaattgctgtgatctaatatgatcctaaaacatggccctagtttatattcctatgagaatgtctaatacctacactcttgctaacattgactgctattgcattttaaagactcaataatttggttggattgatgttgaacatcttctgttattcctggccattgcatttctttttctacctattaatctcccttgtataatattgcattatttgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataattcaggaagaaaacctttacagagattattcttataatgtttgtgatacaatatttacgggcaacataaattctcatccagagattggagtaaatattatatagtatatctgtagaatgaaatgtaccttgctgtttaaatgaataaattagttattatcataaaataaatgtcatgtaaagacatttattttatggtgtataaaattagaaaaacaagttattaacaaaacatgattttttgtaaaatgcttttattttgtttttaattgacataataattgcacatgtttatggggtacagtgtggtgctttagtgcatgtgtacattgtgtaatggtcaaatttaaaaattacatgtattgacagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatactgtactcgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttgtttcccaaagaacaagagagaaagatcaaggaaattgagaagcaatgaaactagatttaattaatactctggcttgtcagcagctttcatgaaagatttgtttgttgaagaagttgaacctattagcttaaacagggattaactctgccaactctgacagagcatggacaattaagagtttattggaaattaattgaaaataatacagtgttgtgaggtgggatgaagatgatttcctttaaggaaattatgccaagtgttttgaatcagccaaggataaacaaatgcagactatcatttgatggaggtattataaactgataacatgattcgaagtataagaatggcaaattgtgaagaatgaataaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatattaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagcttgggggttaggatttcaatatacaaatttggggggacataaacagtcagtctgtgacattgccatttcatcagtaagaattttcatgaactcactattaagatttatgtttaggttttttatgcggatgttctcactttataatattgtttgtctgcatagtttaaagaaaaggacaatgcccaattagaacaggaggtgtcttttgttggccagcaaaatattttaagatgccttgagtgtgaccctacatagagatcatcaaggtaacatcattttgttcttgttctagatccacatgtttcactcaagatcccagaaagaaaatgtatgaaaacacattggaagacaataatccatccttacaatgctagccaatgtttattattgctttctatgtgtgaggaattgtgttaaacacttaaaaagatgttatccctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcatccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattatggacctttaacccttaggccagatagtatatgaggcctagagtagtggaaaaaggtaactggatttacaaaatatgactcttcaaattctgtaagaattcaatatattgaggaacgtttaggtgcatagtaaaattataatttcatattgttgcacagactcaggcagatgaaagagactccaatagtggtcaggtagtacccagacagtcagttgattgtctctgtgctgaaaggatttaaagatgaagaagagtttgctccaatgtatgtttcaatatctcattgttttacaataatatttgaaataatacctaggaacccaacttacaagggatgtgaaggacctattcaaggagaactacaaaccactgctcaaggaaataaaagaggacacaaacaaatggaagaacattccatgctcatggataggaagaatcaatatcgtgaaaatggccatactgcccaaggtaatttatagattcaatgccatccacatcaagctaccaatgactttctttacagaattggaaaaaaactactttaaagttcatacggaaacaaaaaagagcccgcattgccaagtcaatcctaagtgaaaagaacaaagctggaggcatcacgctacctgacttcaaactagactacgaggctacagtaaccaaaacagcatggtagttgtaccaaaacagagatatagaccaatggaacagaacagagccctcagaaataacaccacacatctacaaccatctgatctttgacaaacctgacaaaagcaagaaatggggaaaggaatccctctttaataaatggtgctgggaaaactggctagccatatgtagagagctgaaactgggtcccttccttacaccttatacaaaaattaattcaagatggattaaagacttacatgttcgacctaaaaccataaaaaccctagaagaaaacctaggcaataccattcaggacacaggcatggcaaggacttcatgtctaaaacactgaaagcaatggcaataaaagccaaaattgacaaatgggatctaattaaactaaagagctcctacacagcaaaagaaactgccatcagcgtgaacaggcagcctacagaatgggagaacatttttgcaatctactcatctgacaaagggctaatatccagaatctacaatgaactcaaacaaatttacaagaaaaaacaaacaaccccaacaacaagtgggcgaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacccaaatgtccatcagtgatagactggattaagaaaatgtgacacatatacaccatggaatactatgcagccataaaaaaggatgagttcatgtcctttgtagggacatggatgaagctggaaaccatcattctcggcaaactatcacaaggacaaaaaaccaaacaccacatgttctcactcacaggtgggaattgaacaatgagaacacatggatacaggaaagggaacatcacacactggggcctgctctgtggtggggggctgggggagggatagcattaggagatatacctaatgtaaaagatgagttaatgggtgcagcacaccaacatggcacatgtatacatatgtaacaaacctgcacgttgtgcacatgtaccctagaacttaaagtataataaaaaaaattaaaatattctgcagtcacagtgactgtcttggcttctcttaatttatgaggacctttgtcttatagactcttttttttaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaatttaaaaaaaattttttcatctcttatagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatctgcatacaacttttgattccccccaaactactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcattaagtggaagtagatcatcttaaaggtcttcatcattgttgtgttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacatttcagtgtagtacctatccgtcttccaccatttgctttagtttcagttcctgtatcatggaacggtctatgtcataaaagaagtcaaaagtagtcttgaataatcaaagcttttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttacaacccttcactccacacctttttttcccttcatatccatacttctttccatggttttctctaaattgggtttgtcgtaattctgtagctatgcacaacatctggacacaaattgtgcttttgtccagcaggaatttattgttttgagtttcatggttttctctatcaactgatgacatcttgaaaggtgtaagccttccagacttccatgatgttctctctattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttactaataaatgatctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcaccttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcacgaaatgaggccttatgaatttctctttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgagagaacacactatttacttagatacagaatttactgaagagaccaagtgctcatggcagatactggcaacatgagctctccacagtagcaacagggggtggctacaaaattattataatagtacatacactggaaagtagacgctggagaatattccaaaagatgccagggttggaggggagtgagggttgaaaaatgattattgggtacaatgttcactattggggtgatgagtacagtaaaacctcagacttcaccactagcaatatatccaaataacaaaacaatcatataataaaactatgcttgtacctagcacatttataaaaataaaataaaagtaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaatatatacatatactttatgcattcaggatgtacatagctttttcttaattttttttttatattctaggctatgcagttagtctgttagttttttcaattgcaattctccaaaactttttctgatatatttttttttttttaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcctaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaaccatgatgagtctccatcagtaaaaagatagtttaaaaacttgtagaatttactcatatacatatatttacacatgcatatatgcacacatattatttttctctatatagagaaactgtgcattcatttaaagtgatatttcctctgttaattgacttggagaaatgttcatactgtgttgataagttggaaaatcagtttgtttacatgaggtgaagtggaaaagttaaactacattataaagtacattataggcttttcaaagggcaaaaaagtgtcacctgagatgaggcaatgaagtgctcatggccattcatccctgttttacaccaatagaaagaaaagtttggaaaatgatggatttctcaataaaatttcaaggaagtagaaataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaacccacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataagataggattagaaggtagactttaggctagggttagggttggaaaaatcaaaacacgttgttctctttagagtgagaaattggtttatcccagactttgaaggataatataatctataaccctctggttacgggaaagaagagacctacatgtggccatcttgggagcaaggcagagagcaggctggaagaccttctaggatggatatggacttgtgaaatgcagtagttaaaccaagttttctcagggttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattctcagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctattgtcaaagttctctccttatttgccagttctttttttcatgtcccaatcataatcttaatggtatcgttgatcactcaagcaactaaccctgaagactgcccagtcgcaggagccaatacatctttttatgtttaaactcaatcacttcaaatgttgatcttaccttgtataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcaggtattacgtagtgaggaagcagtgggtgagaacattcagtgagagaccacaatgtaaggagagagtctatctgaccagtggaagcagagactccagactcagaacctttggtacaaagagtaactacagcaaacgggcaaagaatagattgtgaatttggaggttatgtgcttccttctggcacatgaaaaaactcctaaagctttttgtgggtgcaaaatgaaataaaaatctttccccattggtatgaaaataagttaattagcctttacaatggtttgtttttgtgttactagtttccagttgtggctgtttctctcagtttctctctgttttggtttgtttgtttgtttgttgttgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcctgaaaaatggagagctctaactgttgatagggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacgtctctaccataatctataatctgactggataaggactataaataaatagcatatgaaagtctacaataaagcagggagaaaatcatcactggctccgaatttcataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgttatgtcagaaggcgagaagcaagggaaggcaggcgggtaagagaatcgcataacgcaaaggacttcagtgcttcagaacaaaattgaagcgttttaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactggatttatggctcagctgaattgaattattaaactagtattttttaaaacatttgttcctgtaacttgagatggggctacaaataattatactgtataggtaaaaccacacataccctacatggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggatgagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtccaatttgttaaatggatggtctcaaaaaagtcatattagtatttgggttacctttttgataaaatgataaatcaatctccatatattagccttttttttttttttgagacaaagtcttgctcttgtccctcaggctggagggcaatggcgccatcttggctcactgcagcctctgcctcctgggttccagtgattctcctgcctcagcctcctgagtagctgggattacaggcgcctgccaccatgcctggctattttttgtatttttagtagaaatgggatttcaccatgttggccaggctggtctcgaacccctgacctcaggtgatccaccctcctcggcctcccgaagtgttgggattacaggcgtgagccaccactcccggccatatattagttttttagcaaaaatttaacacttgtattctccacagtgtcctaccggattagatatagctctcctggactaaattgtttctcacccacaacaatattgccatccgggagaaaagagatttatagtagtttactttgtactcctagaaatcctttcaagaagtataaaagtgaatacatacatatttaaatgataaacatttatcttcgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccattgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagtttccagaagtcatgttgtctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagttgtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcattaacttaattctgcctttcacatgtgagctcccaatttcccttgtggctatgagccacaagggcccaaattcaatgggagggtggttcgggtctaccatgacaagccaggatggaggagacagaggtcagttattgggagcccagattcttgccctttagaaacatgtgctgtagcagagaggaacccactacagctgggattctggactgacacagggagtgggtagtccatccagggtcacctgattgatagcaggcccttcacatctgcagcccccacctgtgacactgtttttgataccatattccccaaatttaaccctcaaatccaaaatagtaaaactactgagatgttacttatgaatacagtatctctgggtttctcagatggctgctgggaaactccagagatcctcctcctagctcttaacatgaagatatattagaaataaaggtaatgttttgcattctccagatatttaatttgctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttatcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgttgtttgctatggcaaaaaattaaccaaactttacagttttattattagcaacatctcctccccctatccccgctgcttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataatggtagcagacactgttgatactattgataccacaggaaattgactcatggatataggcctccaagaataggctgaccttgtccccacagacaatattccaactatacgaaataaatgagtcaggagttccaagacactcacagtgtagaagccgatgaattcatgaaagtagactgcttaactcaagaccagcacgacaagaggttgttatttaggattaaagggcctcagtaaggcaatttaattgaggctagtttaattttctactttaatgaacatgagagaaacccattttctttcttcttaatctacctttaatctccaattaaatgtacaaattattaaatttgtaaaaactaaataaaacactctgaattcttagtgttgaggaaaaaaataccttgcagaaattcttaatataaaaacaaagctaataagttgccaagaaaaacatacaaataattattttgtaaagaattgtgacatacaatatttggttttgtctattaacatacccttaattagcaatattgcttaaatcttgcacaaagtttctttaataaaaacatttactttatgtgactatgtagttatttgtattggttcaataagaatttgtcctcccttctacctgaatatattactaattagaaattttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctgggattacaggcatcagccaccttgcccagccaggaagaatcaattttttaataaaaaatttatagctgtgctacaaattcaatttaattagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtgtggtctgctctaaactgagctgttaaacatgtaaaagtaaatttaaagcacaagggctttataaatctatagatagacgtaaacttgtgagccttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacattggggcctgacaccattgtcagcccgttcatcatgtcccactgctgaagaaacagagaaaaaaaaactctgcactctgacataaagaaacaataaaagggtctctctgtctacctgcagtcctccaaatgaataaaaccttgagcatttcctgagagttgctaactccttaatgaaaatcactttatccttgactttacaatgctgtttattgtctgaagatatgtcatgaactttctgaatacaataaccatgataaaattgctgttttctgccatgaagagattaatataaaccctatagtcttcataatattgtttgttttaaaaagttctatttttttaattttttgggcagttcttttgaagaatgacttcctcacatttctttgcaagtaaatgtctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttttcatctgcaaggaggatttaaatatttctagctcagtagttcagccctgaagattatttcacccccactgctaatcccgacctaatctgtttttgtgttgttaatgctcctatatactagccaggtccgtaattctgtaacaggcttaatttcttaatattttaggccatgtgttaattttactatttcttagccatttttcctcaatagttttaaattgcatccctgcttactctcccttttactggatgggcttcctctgtttactaatacaattccccaaattgattcatccacttgttgaaatacctaattttaggccctgcactgacagcttgcctaggcttatacttgttgtgtttggtgttgcagtcttcagattctaaaaacaccatctagaccttacattacctccagccagggctattcccccagggcctgccttaagaagcagatttcttttcatgtttcatcttcttcccatttatttcatttcatgacagttagagaagctgtatactaacgtgacaaatgctaagttagcaaagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagaaaggaaatgagatggaattgataaggcaatgcaaataattcaggttatttagatcatcagtgttgggggaagctgggtttatgggaatcaatcgttaatcagaatgtgagcaccattggtttggtaattcatggaagaggttatcattcaacagggggagtggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctgggtaggccccttctgtttgctaaaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataacgtttccctatttggggattggttaaatgcaatattatagaagtctgaaaaaataatgactgtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggcaatgatttctagtttcagtttctattttctgtcaattaaccatcattttggtaaacagcctttttaaatatcttttcttttaatttttaaatttttactttaaagacagggtctcactatgttgcgaaggcattggcctcaaactcatggactcaagtgatcttcctgccatagcctccctaggtgcacatcaccatacccagctattaatgtctttataaaagcatttttaaccctactggtctagctattgcatcaaataaatagctaattccattgacgaaggattagggactcacgagtgaaaataaatgttttatttggataatggctacaaaatctcaacagtcaaaataaataagagattaaagccatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatgtctgtctccatattatcttctctgtctcattgcactttggacatttttattcttcctgcagatctatttttatgaagcaatgtgatttaaatgaaaagagcactgaattctcagccagatatttgagttctagttgaagatttatcacctagtggttatgagatttggggcaaattgcttaatctctctctttctttaccacttcgtttgtaagttttcttgcctcccttcaggactgtattggggatcaatcaatgttgagttgaaggcaacatggtttaagttggcttaatggagaagtggtaaatcacttaaacgggtagtgtttaagtgaacaacacagtgtagaggatgttgggctgcatgaggaagtgtggaaaaaaagcatgccatgaaaatatcatcacaatctcacatttcttcgtttatttgcacactctgaacacctgcatgtgataaagactgtgcaaggttctcaggatacccaggtaaaaatcaccacttctgccagtcttgactttgcaagcttgaggagcagacctggaggaatttggctattaccacaccaaagttgttcctcacattccctttgacatatggtctcaggaaaaaatgaaaagagtaaaaaaaaaaaaaaagtccttcatttttgaaaggaaaagtcataattaatttctagaaggagaaagaaaaaaagagataacagtgtgtgaaaggcttagaaaatgctagagcactacagaaagataacgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattacgcacatttttaatgcttctatacaggactgaaggccaatattaccatgataataaggcatgtaacaaaaatttgttctgcagagagtgagaaagcgtgagggaaaacacagtgcaggattctatgctgtcgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacgtgccatgaaaacagttccagtgctgggccagaaatcaggaaacgtgggcttttggtttctcaccattaaaatgaagaagttggatttatacccaagggcaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggctcccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggattcctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctttcaaaggccccagctgcataaatcatcacagtgggtgttagggcttcaacgtttaagtgcgggagttggtgttcacatttcagtcaattgaggtggcaattgaaatgagaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtggtgaaacccgctctctactaaaaatacaaaaaattagccgggtgtggtagcgggcgcctgtagtcccagctactcgggaggctgaggcaggagaatggcgtgaacccgggaggcggagcttgcagtgagccgagatggcaccactgcactccagcctgggcaatagagcgagactccatctcaaaaaaaaaaaaaaaaaaaaacacaactctctttaaatcacacatccgagtgtgccccttgtttcccaccagagccaagactgaatgagatgatttcttaaggtcaggttgatgtcctaatccagttgtgctgctataacaaaataccacagagtgagtaacttataaacaacaaaaatttattgctcaagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaaccctcccacctcagcctcctgagtagctgggaccacaggtgctcaccaccatgcctggctaatttttttttttttttttttttttgtagagatggggtttcaccatgtttcccaggctggtctcaaactcctggactcaggcaatctgccagcctcctgagggagtgctgggattacaggcatgagccactgtgcccacccccaaaattctactcatatatatgcataattacatagttaccagccgttattttctgatactttgactggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaaggcctggaaagggattccctgtagcatgtagactttccccacaagagacaactttgtagggacatttcaaaatatgataaaaaatgtattttagggtaaaatatttgtatttctttcagggcctgctatctgtcatgtaatgctacactagagtcagcctggagtttggtgtcttattgctacaaaaagtcttgagatcgctgttgtaatgtcagttgggcctggtcggatgtgctggtcagttgtgcctgaattccaaaggaaggagggtataatgaggcatatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccaggaatggcacctggatcaagcatttagtgttcagttgctacactctcacctaatccctcattttcaatattttgccatgttttccagtgacccaactggccaccatgtcacagactttatggtctccaagggagacccctccatttcatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgttttgtcaaattgggattatctttgtgtctttggagaatataaaatactaacatgaggtaagcactaaggttctgagatggccgtggaagagatgacaaactccatcaccatgcctgagagtgtccaatcgtctctgcgggggccacatatttttgtattacactgtatttgaaataacaacaacaacaacaaaaaacccttcaagattcataaaattggacaactgtctttgtaacacttctagtggtaaaaccagtaaggatggctagtttgcaacccatctgagcagcctctctggtttcatagatatgttttctctctgacattgaacggctttcaacttgaaacggaatgctacatcacaaagataaacaggtttgaaaggaaccggttttccttgtaatcctaaacgttcaagtctgcgcattaaaagacattatctgaagaagggtgcacaagcttcctgttggccgccagaagggttctctgcaggacacagatcaagtaccacagtcttagggggagaccagacgcgggatctctgcacacctccccaaaggacaatggcaggaggaaaaggagaaagagacagacgtcacttcctccgccagctccggcagcgggttgatcggctgagtcggcggagggtggggcggaagagcagacggggactgggaaaggcgctgtcggtgacatcacggatagggcgatttctatgtagatgaggcagcgcaggggctgctgcttcgccactaaggagttcccgtgccgtgggagcgggttcaggaccgctggtcggacctgagagtcccagctgtgtgtcagggctaggagggctgtgggcggtgggggggtggggtggggggggggggcgttcgcggggcaagtgaccgtgcgtgtaaagggtgaagcgtgtgaggctgtggcggggcggaggtgcaaaagctcatacttacctggaaggggagataccatgatcacgaaggtggtttttctcagggcgaagcttatccattgcgttccggatgtgctgacccctgcgatttccccaagtgtgggaaactcgagtgcataatttgtgatagtagggaactacgttcgcgctttctcttggtgtttctgtggtgcgaatagtaggtgagccgtaagtgtttttgtaattcagggtgcgggctcgtgttttgtggctgtgttctgtccggtcagttgtttccgttcgcaacggttagttttcctttgtgaggccatgtttggggacagcttagaactatccacttgctctcttgggaggcgaatttcagtctctgttggttgggttgttctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctgtttttttgttgttgttttttccccccctccctaagacaagtctcgctgtaccgtccaggctggagaagtggcgcgatcttcccatctcaggctcccgagtaggacaaccgcacgccaccacacccggctagttttttctctttttttttttttcttttcttttctttctctttctttttcttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgctggggaaacgtgtactcagttaatagagccaggtggaagttgtactcagaactggtggttttctttggaatgaaaaccgtgcatgttgggggctcttagtgtccccgttcggttgtaggcataacacccttgctttgtgtagggggagggctttgcccatgccctggtgccccggcgcagggcatcgaggtctgcagttcagaaccgcagtctaacctatgtcttggcggaataccctgctaagtctccctggaatgtaagatgggaggtcttgtgaggaggtttctacaagtaagaaaacaaatttccattcggtttttattgacaaaattgaaaattataataactgagtccagcctctcagatgacaaatgtcttttgcactgagagctgggaaccgccgcttgcctcagctcctgcgtgcaggtgcagccctcgcttccctccacactttctccagcgggtgtcagttcctccaccagaggcagacagcgttctgcagaaccacagcgctcaaggccttcgagagccaaaaatctcggagcgagctgccctgtcctggctgtacctcacgactgacctagaaatggcctttgctgggagcaaagggtaggggggagatggtcgtcggagctggggcctgtgcactggaccaggttgacccacgggaggggaggtacccagagttagaagggggccaagcactgagacctcaccatcctcaatctccaaaaggactcagagagatgcagagactgagacaagcttcctttttcaaggaaagagaaaactactgaggaaggccccaggggctctgaaccaaaatccagacttttttttccacctgcagctttttgtttttatttttgcttgagaaggtgtctcggtctgttgcctgggctggagggcagtggcgcaatttcggctcattaaaacctccatctcccgggttcaagcaattctcctgcctcggcctccctagtagctgggactacaggtgcccgccatgacgcccggctaatttttgtatttttattagagacgaggtttcaccatgttggtcaggctggtctcaaactcctgatctcaagtgatccacccacctcagcctcccagagtgctgggattacaggtgtgagctaccgcgcccagcccgcacctgcagcttaatcccatttcgctggtgcaacttcatccttccgtatgctcaggccaataaacagtactgtaggctggtcgttctttgacccccatacatcctattggtcggaaaattatgttttctctttggttaaccgcagactttgatatgcacactctttcttggtctgaaacccacccaatagtcccatacgtagatttttggataaacatagaaatggacccttctgatctgaaagtttgaaactcgatatttgttttatttgagttccttccttcaggcctctcaaaaaagatatcaaagaactgaaagtcacccagacaatgagatgccggacccctcattcatcctgattgcttccttgcccctccctagttcctgttttctttcttttcttttttctttttttttcttttttctttttgagacagagtctccctctgcctcccaggctggagtgcagtggcgctatcttggctcactgcaagctccgcctcccgggttcacgccattctcctgcctcagcctcccgagtagctgggactacaggcgcccgccaccactcccggctaatttcttttcgtatttctagtagagacggggtttcaccgtgttagccaggatggtctcgatctcctgacctcgtgattcgcccgcctcggcctcccaaagtgctgggattacaggcgtgagccaccgcgcctggtctagttcctgttttcttacacattgtcacattctttccctgccatctaagcctctagttttggttggtcagggagatggatttgagactgagttctcatctcctccgctgcagcaccctattaaagcctcttccttggcaataaccgtctcagtgattggttttctgtgtggcaagcagcgggaaccccaggtctctgaactttgacaaaggaatctcctgataaaggcgggatcgattttactgaccaagctgaaaacgatcagacgtttgaaagccttaatctcggagcctgtcggagtttggtctgcccttgaggcttttctttgggcctaccagtcaaaatcagcctggccaaacctgtcttcaaggaccaggggcagggccggcttctcccgccgggtcggcagccaccttccccttccctgtgacttgaagagaagcttcagggggcgtttattcaatttgcgaggagcctgcgaggcgcaggtgcgcggtgactctgtggttcccaccgcacccgctgccctctttggtcctctcgctgtcaccggcgggcagtaacgttccgggtgagctagggctccgaagacaccaggcagggagggaccagtgggtaagggcaccgcccgtttaggtcctgcgcaggagggatccgaaaaaggtcttgaagaaatagaaagggagggccagatgcggtggctcacgcctgtaatcccagcactttgggaggccgaggtgggtggatcacgaggtcacgagttcgagaccagcctggccaagatggtgaaaccctgtctctactaaaaatacaacaagtagccgggcacggtgacgggcgcctgtaatcccagctactcaggaggctgaggcaggagaatctctagaacccaggaggcggaggtgcagtgagctgagactgccccgctgcactctagcctgggcaacacagcaagactctgtctcaaataaataaataaataaataaataaatagaaagggagagttggaagtagatcaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtagcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttactttaagcgcactgttggtggaacttaaggtgactgtaggacttatatatacatacatacatataatatatatacatatttatgtgtatacacacacacacacacacacacagggtcttgctatcttgcccagggtggtctccaactctgggtctcaagcgatcctctgcctccccttcccaaagtgctgggattacaggtgtgagccacctcgcccaggccattttaattttaatttaatacttttaatttgaatacacaatccaaaaatcatataacaagtacaggaaacccactttatgccaagtttacaaaaacaggaaagatatgtcaatgacaaagcgtcaaagtggcaacatcctaaagtactgagagaaaaaaagttattctagaattctatgccaaattgaaatatctttcaaaaatgtgactgaaatcaggacatttaaagacatacaaaaaaatgacagaattcaccgaaccacactacaagaaatattaaaggagtcctccaggcctaaggataaggataccaaacagaaatctgaacctacacaaagaaatggagacgactgaaaatcgctatgtacgtacttggatgttggggtttataacatgtccaaaatcaaattccctgacaacactagcataaaggccagaaggggaggtataatgtcacttgatggcagacggataaagatgtattctagggaccctaaagccatcactgacataacaaaagaaagagttacagctaataagccaaataaggaaagaaaatagaatgatatataaaaaaaaaacatgtaatcgctgggtgcggtggctcatgcctgtaatcccagcactttgagaggccaaggcaggcagatcacttgaggtcaggagtttgagacctgcctggccaaaatggtgaaaccccgtctctactaaaaatacaaaaattagcccgatgtggtggctcgcgcggacctgtaatctcagctacttgggaggctgaagcaggagattcgcttgaacccgggaggcggaggttgcagtgagagctgagatggcgccactgcactccagcctgggtgacagagcgagactctgtctcaaaaataaataaataaataaataaataaacaaacaaacaaaaactgtgtaatccctatgctggagcaactgctctccaggcctctaccctatagaaatacacaaatggccaatgagaagtgtacaagaatgatcactgccgaattatttgcaatcataaaatagtagcgccaaagtaatttcaaagatacatgaaaatcgttttatttatttaacaaacacaaacaattgaacaaacaatggaagcaagtccttttgcctaaagaaacacagagggtcatgcggatgttgctcctccaaggatttcggtgttccccaacggctagttttgggtctagttcttctggaagatcttattcttggggagctacaggttctggcgtttggggctctttcaggttctatctccattttcccctcaattcctccccattctgctataataaaaaaaaattctcacctccggaagatcccgcctgtgcctccccgccagcctttcaggaggtctggacgtctggtccaccgctccccggcttctttccccgcttttgcttttcccctcccctgctcccgccctccggcctcaggacccgaccaccgcccagctgagcccccgcggctccacggcgcagaaggtgcactggaggccctgcccgttgccgccccgcggggtgtcaagaagtcaacgtaaataaatgctttgtaaaaggaacttccccatggaaaaatctctcatgatttccattctcaaggctcttcaaaggactaaaagctaaaaggatggattcattcgacaagtcctagtcctgcgccctggtgagtgccagaccctgctccccgtgagggggacccacgagccaccctcaccacgatccctgccctggtggagcccccgtgcggaacacaggatccgaagatggcagcggaagctccgcagcggccccaaaagcgactgggcagggagggcacaggctccctcactgggtgaaggcggcgcaaagaatgggaagagccatcccgggagccaccgggcgttcagcctccctagggcccccaggcggctcgggccggggtctcaaccggggcgtttccgggggtttctgaagcaggcgaggggcagggcgggcgaaggccattcggctatccttctggctccagaatctcccaacgcgcaggtgtccaacgtgaccagcgcgacttaccgctccaatctctccagttttccaaggccttgctcagtcctcctgccgggcgggccctgaggatgcaagggacggaggaagtttcgtgcgtgcgcccttcctatagcgcccagtagaactaacagtacctgtctctgtggcgcaatcggttagcgcgttcggctgttaaccgaaaggttggtggttcgagcccacccagggacgcctctttgagcttttaaagtattcatgcattgtcaatcactagataaatggggaagattttatcttcctggagtcctaagccactaatttgtgacttatccatgtcaagggccagcccacctccccaaccggattcttaaccgggtatctcctgaaatcctgggtttatacgtgtgtaactcaggaatcctgaaacagagacctaggaacccacttctggtgtgataaaattctaattcagtccgttatacgcttaaatgagtaatttacatgcctccattttttcatatgttaataataggaggtcagtaatatcccgaggatgtgcctggatttactgattgctctatcaataatgtgaccagtggaatcattcatcatcatagtgatcctctccatcatttttgaagagtatttttcctcagtttgtgcatgatttatttaacccttttcaaaatgtttttgttagccaggcatggtggcatgtgcctgtaatcccaggtacttgggattctgaggcaggagaatcatttgaacctgggaggtggaggctgcagtggaggctgcaccaatggaggctgcactgctacactcccgcctgggcaacagagcgagactccatctcaaaataaaaataaaaataaaaaaataaagtttttgagatgaggtaggtttcattgttttaggattacaaagaatgctgcagccacctttcttgtacacatatctggtcattgtggaaatgtctacaccgcagatatttctatagtgtagggaagttgatgcactattgctacattataggctttacatgatgcttctaatttgagtacattctgcaaatgtatctttcacgggagccgtaccaaataatattccaatagcaatatttataggaggaaaaatgtgcagaagtgcaattgagcttcgtgcctctccatggggtccatgttcataaaatggtggcattagcaatcatctgagagtggagtttgtggccctctgacatcaaaagctgaagcagaggacatgaaaaccctcactgtgcatcctctctagtctggccagaatcattcctaggtcggtggtctcttatcaggagggaatgctgcttgcttgttttgtcaaaatcacaaaactgagggaaagcatcaggccgttggttggtaacagtggtgaagcaagtctttccaaagggctggtttgttgttaacccttagggaaaaaaaaaagccttttttttttttttttttttttttttgagacagagtctctctctgtcgcccaggctggagtgcagtggcgtgatctcggctcactgcaagctccgcctcccgggttcaggccattctcctgcctcagcctcccgagtagctgggactacaggcgcctgccaccacgcccggctaattttttttatttttagtagagatggggttttaccgtgttagccaggatggtctcgatttcctgacctcgtgatccgcccgccttggcctcgcaaagtgctgggattacaggcataagccaccgcgcccggccaaaaaagcctaattcttaccagctggtgccgtgcagttccaggctcttggtgtcccaaacaaagacaccaagagcctggaactgcaccaaaaaccaaaaccaaggtaggggcaagatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttaaaagggaggaaaaccatcaaaaacatttttagtgcaatatttaacatgagctatacaacccttcctaaatgccaaaggcacacacagacacacacgcagacacacagacacacacacactcacactcacgaagaatacaaatgactagaaccaagaaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccagaagtccagagtgataggcaaaaggttttaattgtatagattaaaattaactttggacaaaaattaaaactcaggcagagaatgtcttcttctttttgcaacagcagacactagtaaaaacaaaggcacagtaaaaattgagacccaaaatttgcagtgtagagatatgaatataataatagacacaggcagggaggattaataaatgataaaatgtttagaggatgatcattagaatacaggatatttatactcttgaaaaccgctttcccaagtacttcttcattataagtaaggtgtctctaaaagggacagatctcctagacccctccttaaccaagtaaccagtcctgatatcataatggtgatggacaaactagaccttctctgcccgcagatgggctgaggttggaaactcacagcattgtctctgcagtgttcccggcaaaacgtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttacgttttttgaacccaaaatatctcttctcctttttgttgtgtgatttgtggtgatatggactatgtgaaggagacaggtcagttgtcctgctcagtgttctacattctgcagttgtctggtgattacctcctatgaaactcaggctaagcgttttctgcaagaacatggcattgttcatattctgcaccggcagagtcctgggtgacatgctgtctcctgccagcggctcctgactcctgttctctacaggatggaattgagaagagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcaaccaaggatccctcctgtgttacagatggatcagctaaaacaagccaacactgaagacacaaagaatgaggttaggttcattgaaaccagggtaacacctttggatgagctaaacacaaagatgacaatgaccttgagcaggtatagaagctcagagacatgcctgcaaaatgaaatccctgaggaattttgtagctacccagagatacgtggttcaaattaaaatgtctgactgatcactcccggcatgtgctgcacagttatgtgaacgtgtcacacctaacgtgggtccattgtcttcagactgagcacaggttgccactggcatggtttgagaataggaatacagccatgcccactgacccatcctatgtctgggcttccaaatggaactgtactttcattcaaatcttcacgtgcctataggtcctgcctgcaggaatgacatctctcggcttagtaagggctgtttattgtgggaatatgactcccatctggaacaccaggtggagacttgtcaccgtcaaagtaaaaaacctattgtccacgtaaagggcgaagctgatgtgctgttcctcaaatgagtaaaacacacttctgtagtgctggaatgagtcaggtagttcaaagtacattgacggagtagaataacatccatccagtgagtcctgtaagacttcaggctcttccacttccatcagcacgccgttgagcctggaaaaggagacaaaactaaagaagcagccagggaaaatcagaaaccacagagccccactagatttcagaagtcacataaggaagtggttagaaaagaaaaaggatagatccattaatgaggtaaaaaaaaaatttattgcctatatgttgggatagaacagggccaggtagaaaacaatgaaagagaaagacagagagagagagacagagacagagagagagagaaagtgacctagtgaattgcccaggtgacatactggtaagggagtcaaaggacactctgagttagtgtcctcatgacacacagcaaactgtgatcatgaaaagagtgagctcaatagttttccataaaatatgctcaaaattcgatgcagtggccatgagagtacagcttttgaagtatggtcaacctatggcacgttagtaaaagataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttcttttcttctttgatcttcttccccttcttttcttccccttccccttcttttcaatttctgcaataaattcagacatggacagacacattaagctgattcccctacacacataacaatccactgtctaatcctcacacagggacctcaggctccccagcataagaataggacactttgagagatatatttcaggaggcctgaaggctgttcatgatagaacttcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacagacacacacacacacacacacacacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagattgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatagttctgtgaattctttacatctgcctgggtccaatgtgctgagagcgggctcagcttgccacaggcatggctggagactaggaatagagccttgctcactgacccatttcatgtctaggcttccaactgagactacagtttcattacaacttatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacagagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacagacacacacacacacacacacacacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagattgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattctttacatctgcctgggtccaatgtgctgagagcgggctcagcttgccacaggcatggctggagactaggaatagagccttgctcactgacccatttcatgtctaggcttccaactgagactacagtttcattacaacttatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatatcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtggggtttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaagtctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagaggtagtcttcaggaggcctgaaggctgatcacgatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacagagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgtcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagaggtagtcttcaggaggcctgaaggctgatcacgatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacaaacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatttaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttggcatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttggcatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaattctcacacggggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagcgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccatgggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacgcagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtacggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagacacacacacacagacacacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagactttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacgcagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtacggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagacacacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcgacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagcgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaattatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacggtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgtcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagcgaggattttagacgctgaaattagagtgaaggatgaaatctacaagatctacaaagttgagtcaaaatcagagttgtgtgaatttgtcacatctgcccaggtcgaacgtcatgagagtaggattagggcaccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaatacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaagaaattattgcctttatgttgggatagactagggccaggtagaaaaggatgaaagagagagacacacactcacacacacacacaaacacacacacacacacacacacacacacacacagagcgagctcagtgaattggtcaggtgacacactgatgagggagtcaaaggacactctgtatttgtgctctcaggacacactgtgaacagtgatcatgaaaagcatgtcctcaataattttgcataaaatgtgctcaagtttccctgcagttaccatgagaatacagcttttgagttatggtcaactttcactaggttagtaaatgataagggtaggaagaaatggaaacctaaacatgtactctaatgagaaccagaaagcaatgtagtaggcataattcagacttgtctgacaagacaaaatcattattttcagcatgtactgttttccctggacttggcatctccaggtgtcaacatcaaattaactctccacaatttctcagactcacctgggacctgttgcctcttggtcctcctttttcacttgatcccaccgatgtcctgcaaataaattcagatgggccctcttacattaagcagttcttccttgcacacagaaacattcctctgtccaatcctaacacagggacatcagtcttgtcagtgtgagaacaggagactttgagagaaatattccagtaggcctgaggtcaagtcttgagaaaactggcttgggttctttcatgagccttgggcaaaattcccctgtgttggaatgttatcttccctatgtgctctgtcctaggcttctgtacacaaatgagaaattttttccccaataaattgtaggcaaatagttctaacacctcataggagagacacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgatggacagatgagctaaaacaagcgaacttagaagacacagaaaatgggaataaattcagtgaaacctgggtcacatctttcactgagaggtagacaagggtgacactggccttgggcgggtaaagaaccacacagacatgctttgggaacaaaactcataaggaattttgtagctggcaagagacatttaattcagatgagctgagctgacagacaactcctgggcatgtgctgcatagtttggtgtgagtttgccacacctgccttgagttcaatgtcgtgacaatcagtccaggttggcacgggcatggcctgagactaggaagagagcaaagctcactgacccaccccatgcctgtgcttcagactcgactccagagtgattgaaatctacattgatatataggttcagcccacggtgatggcaaatctcagcccaacaaggggcacaaggcccaaagattatggggtctacctgggccatgaactggagctttatcaccttcacagtgtagtactcactgcctatgtcaacagccatgcagacttgctgttcctctaatgagtgaaatgtgctgctgtaagactggtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactatccttctaaatgcagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacgcagtgcagacacagatcttgtgtattaagggccccattttcccaatattttgatataatatatttactttttcaatttcttttcttgcaaaaatactagccaacatactaccaacaaataggaaaaaagcatgtatacacctctccctggatttaaacacatcggagagaataggcaacaccaagaaatccctgtttgagggtctggagtggacttccagcaaactccaacagacctgaagctgagggacctgactgttagaaggaaaactaacacacagaaaggaataacatcaacatcaacaaaaaagacatccaccccaaaaccccatctgtaggtcaccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatggagaatgactttgatgagctgacagaagtaggcttcagaaagtcggtaataacaaacttctctgagctaaagtaggatgtgcgaactcatcgcaaggaagctaaaaaccttgaaaaaagattagacgaatggctaaccagaatgaacagtgtagagaagaccttaaatgacctgatggagctgaaaaccatggcacgagaactacgtgatgcatgcacaagcttcagtagccaattcgatcaagtgcaagaaatggtatcagtgattcaagatcaaattagtgaaatgaagcgagaagagaagtttagagaaaaaagagtaaaaagaaatgaacaagcctccaataaatatgggactatgtggaaagaccaaatctacatttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacttaattgtcagattcaccaaggttgaaatgaaggaaaaaatgctaagggcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatatatatatacagatatatataatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttcccctttctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagtgccacaataaacatatgtgtgcatgtgtctttacagcagcatgatttataatcatttgggtacacacccagtaatgggatggctgggtcaaatggtatttctagttctagatccctgaggaattgtcacactgccttccacaatcgttgaactagtttacagtcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcagtaaacatggaaaggaacaaccggtaccagccactacaaaaacatgccaaactgtaaagaccattgacgctaggaagaaactgcatcaactaatgggcgaaataaccagctaatatcataacgacaggatcaaattcacacataacaatattaaccttaaatgtaaatgggctaaatgccccagttaaaaaacacagaatggcaaattggataaagagtcaagtcccatcagtgtgctgtactcaggaaacccatctcacatgcagagacacacataggctcaaactaaagggatggaggaagatctaccaagcaaatggaaaacaaaaaaaggcaggggttgcaatcctagtctctgataaaacagactttaaaccaaccaagatcaaaagagacaaagaaggccactacataatggtaaagggatcaattcaacaagagttaactatcctaaacatatatgcaccgtatacaggagcacccagattcataaagcaagtcctgagagacctacaaagagatttagactccacacaatcatcatgggagactttaacaccccactgtcaatattagacagatcaatgagacagaagcttaacaaggatatccaggacttgaactcagctctccaccaagcagacctaaaagacatctacagaactctccaccccaaatccacagaatatacattcttctcagcaccacatcacacttattccaaaattgaccacatagttggaggtaaagcactcgtcagcaaatgtaaaagaatggaaatcacaacaaactgtcagaccacagtgcaatcaaattagaactcaggattaagaaactcactcaaaaccgcacaactacatggaaactcaacaacctgctcctgaatgactactgggaaaataacaaaatgaaggcagaaataaagatgttctttgaaaccaatgagaacaaagacacaacatatcagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagagacacaaaaaacccttcaaaagatcaatgaatccagggctggttttttgaaaagatcaacaagaaaaccctgtttggctagttcacctggctcatctgatggcaagttcctatcttgagaggactatgaaattaaaaccaatacaagtgctacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctagggtgtcctagattaactttggtgagaattagataaccctgctttccagacccacaggccaaaatctccctctacgtgtagaccataatgccatattccctgcctgagtcaaagttaaacaaaattttttccccaaaaaaatctccaaaaattggtcaaacaattttctaagagtgctgctgcgatacggacttatatcaccaggtaacatggacattaaatgtttagaggcatctatacatgaaacacgactgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgccactgcactccagcctgggtgacagagcaagactccatcacaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttctgtcctgatttcagggtgactgtgcagctaagcaagctgacttaaaggagatccagatgaaagctgagagcagtgaagccgggggaacaatatttccaaatacaaaggcaaggctgccagcttccttaaacaggcatagaaattccatggacattgttcagggacagaggacttaatcacagatgacaagagatactgaatcgaagctagtaggcctgacagatactgcctgtgcacctcctgcactcaggtgactatgagattgtcacacttgcctggggttgagtaacttgatactggggactggcagacaaagtcatgacattagctgagaaggacaaaaaaagtccctgatatctgtttagaaacccatcacagttttttattcaaatgaatttgtgtttatagagcctgtcttcagagtttatcttcctcagcctagagagaggtatgagacacaaggaaaacagaggctacctggaataatgtgtacagcatcctcccattcaacatgagaggatgagccaatcagagttgagtcgactttgtcttcctcaaatgtgattttggttttcctatgtggctggttggagtcataagggccatggctatttgaataagtgatggcacattcctcctgtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggaggttcccattaagggggaacatgcaatcctgttctctctgcaacagagcatggctgccatgggaaccagagaggaagagagcagctgctgttcattgcactggacagataggagctgaggaggatgaagactcagctatccctgtacggtgcagacgtgacactcggcacacacagagaaacatgacagctgccgcaccctgtgtctaagctgggttatatttcacatactgtggccaagcaaatgtgggtttttggccgatcatagatgccagagagggtgtgcctcctagatattcctcatatgttaccatccattaattgttcctgagtattcagtgttacctgggggcagacgatttctgcactttctcagccaactcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggacgttggcagctgtctcccccatcctgccagatctgattcccaggcacaggcttggtgtcctgtcacggtttgcatttcaaacctcattctttctcttagaagcagacaaacttgtcccacagtcctctatgcatcagaagatttcaagcctccaagtggcttctgctgtgttcttcagggacattctatccatggggagtgctccagtctgaagcacttcctaccacaaaacgcccccacataaagtgccttctccaacatcacacggcgagggccttcatctcattttggaaagcagttgtaagtgttcccacatttgaatgcttcagacccttgcaagagacaatttgtctgccacggagagagagaaactcaggaaggacaagtcattcactctctgacagttactaagaacattgccgaaaagacagcctgggaaccttcattcttagtgcagagctctttcactctaacaagcctgctcccatcgcagcctccttcctgtcctttaaaactagacagatgctgcctcttgctccaaagaccaccttccatcaagggaggagggacacttgcaatactgtgacctccaaccccatgggtttcccatctccgttcttacccaagaagtcctggtcatgtcatggccacataagcttagtggaaaaaaacaccattgatacaactgtcattgtgaaagtatggaggtctggagtctctcataagcctgggattttgggtcatcagggcctatggccaccttacctgggctgagcttttggacaaggtgctgtgccagtctacacccctcagccagctgttcttggaggtcctgcccctgggacttgtccggctcatccggagtaaggagggcctggagatgctcattcaatgagcgggaggcatctctcccttcccgcaacttctcccttaactgggtcagctctcgttcctgagcgtgaaccaggactttatattgcctaaggtgagacggtagagaaaatttaagagtggaaaggttcagtgatccgctcaaatattgcaacagagatttctgagataatgtcctcaaggagacctcgaagcagaaggtcagcacatgtttaaaggaatgtctgtggccaagagaaagaatagaaaatggtttacaggcttcctctgtatcagagagggctcttgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagctatgtacagaaatgaggccaggtgcagatggggcgaattgaaaagacgaaagaagaaaagaatgacagggtcgagaaggcaacattgattgagtgaaagaatgagaagccgcagtcagtcaggaggtgattgtcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccatacatttttattatccttcttctctgtttgataaatatttatgtgtagcgagcctgccatggcaattcctgcccttcccctggcccagcttagctcttacgtctccccaccgagctgctgtatttcagagatttacacacctgcccccctgcctgccaccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagagaacctcaagggcacatcaaggaagttgacaagatgattcaaccacaacgaagtggagtcagaattcacagtccgtgaggtctgactctgaatgcggggccactttcccaagccttgcagcctctcctctaaaacactgcactggggcatgaagtagtgatttcttgtacagtcgggaaggcccctaggactatgggactgatggtttcccttttactgggaatttcaaggacaagtatgtgaaagatttttaaaatctttgatttttaaatcatatcttcagttatgattttaagaatcatatctgaagcataaagtgtgacacataacaccttaaggccatgaaggaaatatgcccaaatgttaataaagtttgtgttaatttagaaacagcagaatgaagaactaataaatagtgttcactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccactgtccctgctctgtacactgcactgttatctccacacattctcgggtgcgatctttcttcctctttagcaacaagactctgtgccccaggaagcaggacttcactctcaccaagctactctctgctttttattcttatttatcattattattattattatttttaccagtcttgccctgtcgcccaggctggagtgcaatggcaaaatcttggctcactgcaacctcagcctcctgggttcaaaggattctcctgcctcagcctcctgagcaggggtgattacagtcacctgccaccacgcccatctactttttgtatttttagtggagatggggtttctccatgttgcccaggctggtcccaaactcctgacctcatgatctgcccgcctcagcctcccaaagtgctgggattacaggagtgagccaccatgcacggcccctactccctgctcttgatgctgtcacttatagacagcacaggttctattaggagtagactcctcttgaagcccctcagagcaggtactggctactatcaccaagtttccctcagagtcactagaacagagctttgcctgttgggcctcaacagaaacttgaactgaataaaagttcactagtctcagacatttagaacaacagactagatgttatttgtctgcaggatcttatatggtagagaggattcttgaaaacacgattgagcctcttggagaaaacagatcattctgtgcctgtgtcagaaatcaataaatggcagtttaactctagtcccacccccatctgattgcaaacatggaaagttgctaaatactttggtacgtctgtcttccaactttgacaaaatgttaaaatacccatttctgttttcctagaagtatggggaggatgacattatttttgatggagagagcatttagtgtctcagaagacaggacatcattcatcactttcatgatggtgagcctatagatcttactgtatttcttctgctggttggccaggaagccggccagttgagttacaaaacatctctctttgaggtttctgaactgctgtttcttctctgccagctgggggtgcaatttctcattgatttctagaatgttcatctctgccttctcgctggacaaagggccggctgataccaccatgctgacgtttgtggcagaagaggtggggccagggactggggagaagaaaggcaaacacatgatgggttaaaactggtgaaatcaaataggcttaatcaggactgagggatgtcactggcagccttgtgtacttatttgaagatgatgtttccctggtttcactcttgtcatctccagtcttgatctcctttaagtcaacttgtcttagctatgcagtcaccttgaaaccaagacataaacacttctacacttttcttgcttatacgtttctataaagcaaggcttggccctgagatttttaccccatgagtagccaatgtttctgtgtagcacaaaagatttcattttgcttttttaatttttttcttttttggttttttgttttttgtttgagatggagtctcactctgtcatgcaggctgcagtgcagaggcacaatctcagctcactgccacctctgcctcccgggctcaagcgattctcatccctcagcctgccaagcatctgggattacaagcgccaagtaacatgccagctaatttttgtatttttagtagagatggggtttcgccatcttggacaggctggtttcgaactcctgacctcaggtattccacctacctcagcctcccaaagtgctgggattaagatgtgagccagtgcccctggtcacagacttacttttttttttgagatggagtctcgctctgtctcccaggctggagtgcagtggcacaatctcggctcactgcaagctccggttcctgggttcatgccattctcctgcctcagcctcctgagtagctggaactacaggcgcccaccactgcgcccagctttttttttttttttttttgtatttttagtaaagacggggtttcaccgtgttagccaggatggtctcaatctcctgacctcatgatccacccgccttggcctcccaaagtgctcggattacaggtgtgacccactgcgcccagctgagacttattaatagctaagacaagccaatgaaaaggagagagagtctagcctgacagaagtgaatgagggtgggaggatcatctcagcccatcctcccacctaagtctcctgagcagttgggactataggcgtgcagcaccatgcctgcctaattttttgtattcttcgtaaagatgggtttcaccatattgtccaggctggtcttcaactcctgaactcaagtcatcgtcccacttgggccttccaaagtgctgtgattatatgtgtgagtcacagcacctagctccatcctagtttctgactaaaacaataacaatatgtgtatatacagcctgtcctcagaattgatcttccatagcctagacagaggtatgagacacaaggaaaatagaggctacctgggagaatgtttagagcatcctgacattcatcatgagaggattctctgtctacaaccagagttgagttgacttcgtcttcctcaaatgtgattttgatgttcttgtgaggctggttggagtcacaagggccgtggctatttgaacaagtgatggcacattcctccagtgagtcctcagggactttgctctcttcagtcttctgcacctccctgatgagccaggtgggacagagatgacagaagattaaacacagagggattggaccccagggagtcctagctggttttgacagacggcattaagagagtggttccagaaagcaaaatggaggttcccttaaagagggaacaggcaatcctcttctctctgcaacagaccatggctgccacgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagggaatgcgggcttttggcccaccatagatgccagagagggtgtgcctcctagacattttcatatgttaccacccattacatgctcctgagtattcagtgttacctgggggcagatgatttctgcactttctcagcctcctcaacttgaacatcttcatcctcatcttcgtcattttctataaatacaaaatgttcattcagatatttcccacttcacattctgcaagcacagtcagcccaacgtgcacagagacatgaacatctatgtatggttcagcattgtactgaaaactctcatgttttatctttcacaaaatgccctggcatggtttcctgctccatcgggcaatgcatttctgatgtggagggccaccatcaagatgtggccaaatactgaaaagaccttttgcttcccatatcactggaggcttgtgcagcctctctctggactttggcagctgtctcccccatcctgccacagatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccatggggagtgctccagtctgaagcacttcctaccaccaaatgaccccacatcaagtgccttctccaacaccacatggagaggggcttcatctcattttgaaaagcattcgtaagtgttcccatatttggatgcttcagacccttgcaagagacaatttgtctgcctttgtagatggagagagagaaactctggaaagataaatcactcactcaccgacacttactaagaacattgccaaaaagacagcctgggaaccttcattcttagcccagaactcttttcactccaacaagcgccctcccatcacagcctccttcctgtcctttaaaactagatagatgctgcctcttgctccaaagaccaccttccatcaaggaaggagggacacttgcaatactgtgatctccaaacccatgggtttcccatttctgttcttacccaggaagtcctgatcatgtcatggccacatatgtgtagtagaaaaaaaccccactgatacaactgtcattgtgaaagtatggaggtctggagcctctcataagcctggggttttgggtcatcagggcctatggccaccttacctgggctgagcttttggacaaggtgctgtgccagtctacacccctcagccagctgttcttggaggtcctgcccctgggacttgtccggctcatccagagtgaggagggcctggagatgctcattcaatgagcgggaggcatctctcccttcccgtaacttctcccttaactgggtcagctctcgttcctgagagtgaaccaggactttatattgcctaaggtgagacggtagagaaaatttaagagtagaaagggttgagtgatccgttcaaatattgcaacagagatttctgagacaatgttctcaaggagaccttcgagcagaaggtcagcacatgttgaaaggaatgtctgtggccaagagaaagaacagaaaatggtctacaggctttccctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaaatgaaaagatgaaagaagaaaagaatgacagggtcgagaaggcaacattgattgagtgaaagaatgagaagacgcagtcagtcagaaggtgattctcactaagggtaagtggggtggcgatagcacaccattttgattatactgaatgctgctgggtggttcccactcctttggtgaattttgtgttatgtaaatttcacatcaacaattacttgtttgaaaaagagaaaacaaggctctaagaaacaactgcaacacagaacttattattatccttgttctctgataaatatttgtgtgtcatgagcctgccatggcaatttctgcccttcccctggcccagcttcgttcttatttctccccgccgagctgctgtacttcagagatctacacacctacccgcctgcctccccctacggggtcccctcacctgagctcctcagcttgcttgagctgctctgcaagcttctcctccttgaactgtcgctcattcctcagcataaattttatgaggtctttacactcttcatagtctgagaaaagacagacacgcctgcctcagtggaaggctggacatgctgctgtggtcactgcctacagggcaggagccaggtccatcccaaggacaaaactctccccagtaccagggtctagacagggatttccacatctttactcttcagtctcctgactttctggcatctgatcctccaaaatttaaagatgaagaaagagaaactcaagggcgcgtcaaggaagttgacaagatgattcaaccacaacgaagcggagtcagaactcacagcccctgaggtctgactctgaatgcggggccactttcccaagccttgcagcctctcctctaaaacactgcactggggcatgaagtagtgatttcttgtacagtcgggaaggcccctaggactatgggactgatggtttcccttttactgggtatttcaaggacaaatatgtcaaggactttaaaaatatttcatttttaaatcaatattcagatatggttttaagaatcatatctgaagcataaagtgtgagacataagacaataaggccatgaaggaaatatgcccaaatactttattagtatgagaggcagcattaagatttagattagttgtgttaatttagaaacagcataagattagtttgtgttaatttagaaacatcagaatgaagaactaatagatagtgtttacactgtgccaattaatgttcaaggagattgacaggaaatgcctcatgtaattcattgcagcaatttacagaggtaggtattattgtagtaccctctgaacagatgaggaaactgagggacagacaagacaagcaacatggatggagcccaggagacaggctgagggtccctgctttgcacactgcactgctgcttccacacattctcgggtgtgatctttcttcctctttaggaacaagagcctgtgcaccaggaaacaggacttcgctctcaccaagctactctctgctttttatttttatttttgatttatttatctttttgtttgtttgttttttgacgagtcttgccctgtcacccatgctggagtgcaatagtgcaatcttggctcactgcaacatctgcctgctgggttcaaaggattcttctgcctcagccacccgattagtggtgattacagttgcccaccacgacgcccatctactttttgtatttttagtggagatggggtttctccatgttgcccaggctagtctcaaactcctgacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacacagctttgcctgttgggcctcaacagaaacttgaactgaataaaagttcactagtcctagacatttagaacaacagactacatgttatttgtctgcaggatcttatatggtacagagaggattcttgaaaacatgattgagcctcttggagaaaacaggtcgttctgtgcctgtgttagaaatcaataaatggcagtttaactctagtcccacccccatctgattgcaaacatggaaagttgctaaatactttggtacctctgtcttccaactaacaaaatgttaaaatacccatttctgttttcctacaagtacaagaaggatgaaattatttttgatggagagagcatttagtgtctcagaagacaggacatcattcatcactttcatgatggtgagcctatagatcttactgtatttcttctgctggttggccaggaagccggccagttgagttacaaaacatctctctttgaggtttccgaactgctgtttgttctctgccaactgggggcgcaatttctcgttgatttctagaatgttcatctctgccttctcgctggaccaagggccggctgataccaccatgctgacgtttgtggcagaagaggtggagtcagggactggggagaagaaacccaaacatatgatgggttaaaaactggtgaaatcaaataggtttaatcaggactgagggatgtcagtaactgaaattcttaccttactgttgtgaaaaatgtgatcactccccacagcactttaggatccttcaccacaaaaacaaggttcaaggtgcctcaactcagagctgaaagcactgccagtagctcagactctgataagagtgaggtagattgtggccagcgtgccaggtaaccgtctgcagttgcaataacagaattagaaggtgggggtgtcatggaatcttaggagccctgcattccaattgcccaggctttgctgaaacacaggcaccctagtctcacctgagggtcaccaccaatggggatcattccttcagcattcactctcagtattcgtgtacccttgtgacaatgccacagacccgtgtctttcccaatacatctaagcatattcctcactgtttatctcttgtctgtacaacatcatcaaggcagaaacagtttcccaacaggttatattttcttaatggtagtcatgaagtcataaataaaaaaatggaatcatttagtatgttctcttgttttgactttttctttttttttttttggagacagagtctcactctgtcgcccaggctggagtgcagtgacgcgatctaggctcactgcaagctctgcctcccaggttcacgctattctcctgcctcagactcccaagtagctgggaatacaggcacccgccaccacgcccggctaatttttttttttttttttttttttgtatttttagtagagacggggtttcactgtgttagccacgatggtctcgatctcctgacctcgtgatctgccgcctcggcctcccaaagtactgggattacaggcgtgagccaccgcgcccggccgacttctctttactcaggtgggtatatatgccactaatttgtttgattgtgtttttcccttgtttcattttgttttggccaagtaatatcctattgattgtatgattatcacacaattttatatccatttttctgatgggagacaggtttacttgataactactgtgcataagtaactatgaatattctcatacaattatttctgtgaagatacatacttattttcctgggtatctatagctagggatggagttgcttggtgaatgggtagaaaatgttggacagagttttgcaaagtatttgtattgctttacatttctatgaaagatgtaggccatttccagttgctctacattcccacacacttaatattttcagtcttttaaactatgccaggtgtgtagtgatatcataaaatttggttttctcatgcctaatgttcatttagatatcttcttatggaaaatatcttctcaaatttttatattcattgatatactgggctgtttgtcaatttctttgtaataggagttctttatatattttgaatgagtccatttatacatacatattttttgctgtattatatagcaaataattattcctggtctagagatagcgtttaagttgttaaacaacaacataataaggagaagctttttaaaaatgaagtgcaattcgcttgatttcttattgtggtgagtgctacagtatctagtctaagaaatattttcctgtgtcaagttcatgaaactatttcctatttttcctttacaaggtttctaattttaactttcacatcttaagataatttcaacatatgatggagagtggttaatattaactttttaaaacaacaaatattatttcactcaaaatcgttttacttaaaagtctttcatttccccaatgaagggcattggtgtctttgtttttaaaacatttagaagcggcggtgcgagcatgttctcactcatgggtgggaactgaacaatgagaacacttggacacaggacggggaacatcacacaccagggcctgtcatggggtgagggctgggggagggatagcattaggagaaatacctaatgtaaatgacgagttaatgggtgcagcaaaccaacatggcacacgtatatatatataatatatatacacgtgtatatatattatacacatatatacatgtatacacgtatacatgtatacatgtatatacgtgtatacacgtatatataatatatatacaaacacatgaatatatataatatatatacgtgtatatacatacgtgtatatatataatacgtgtatatacataatatactatatataacacgtgtatatatatattatatatatatatttttcttttttaagtggcggagcgagggctactgcacagctagcagagtcgtggcgaggaggacagcacctgcatcgagctctccgcctcccccacccgccagcccaggcggccccagcagcagtgaccagaagagcccctgcagcaacgcaacggccaggtggacacctccatctacagcctcgtggcggacgggacctgttaggacacggccattgtgggcaacaaggacccaccttccatctgggccgccgtcccagggaaaaccttcctcaacatcacgccagctgaggttggtgtcctggttggcaaagactggtcaagctttgtcatgaatgggctgacactggggggccagaaatatactgtggtcctggactcactgctgcaggatggggaattgaccacggatcttcgtatgaagagcatcggtggagcccccaccttcaacgtcattgtcaccatgactgccaagacgctaggcctgctgatgggcaaagaaggtatccatggcaatttcatcagcaagtaatgttatgaaatggcctcccaccttcagcgttcccagtactgacctgctttgttccttccactccaccgctccccacagctttgcctgcctttccttcacatacacacaccattttaatttcaggagtcattaccccacacaccttattgctgccaaaaccacatgggctgggggccagggatagatggacagacaccttcccccacccatacccctcctgtgtgtggctggaaaacttttttgttttgatggatttcttatgaataaaaaagattctactaaaaaaaatgaataactgtacatatgtgggcatattgtttgaatctgtattctttcactttgatatatttatgaatacttacaccattactactgttttaaaattactgtagctttaaaatcaggtttgaaatctagcagagtaagtcctccaacttattgcttcttcaagaccgacttgcttattctaggttctttgattttcaaatacattttgaaactagctttcaaatttctctaaaatctcctactagaaatattaatcagaattgtgttgatgtaatatgctaacaaaattgagtcttccaatcaataaacatgatatatatttatttagccttaatttttctcaccaattgcttttaggggcctcgtacctgcttcattgcatgtattgttaagcatgtaatgattctggttattaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatacactaacggaactactgccacaaccaagatagaggaaattccctatgccccaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtctcgtaaatactgagtagtattccttcgtgtggctataccatgtatgtttgtactttcacttattattggacatttctatcattccgcgtttgggctattatgaagaaactatcatgagcatccatacgtggcaggccaggtctcactaacacaggcctccctaacaactgtttcagtaccgactgagtggttcaattaaatattaagaggaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttattgggggtctgaagaaactccccaggcctccacaaacaagtttattggagatctgaagggactctccaaacctctgtgatttagcaggagacaagataagggcccccagcacctagacccatttagattaactgaatttaactgaggttccagaggaaggtcttcaggactcagacttatagattaaaagaagttaatcatttatgtatttagatgaatgcacacttccacatacacatatagcttagaaggtacattagctcaggaaaactttccaattttgagttggtctggtgataatttccaggccgtttccctgtaaccagttgcagaagtcaaaactctcttcctccccagttcatctgtgtctcgttacggagccacgagaaacagcatcccgcccctcaggttggtctggaaacacacatacagatcattgtgcagacacagtgtgtaaattcctaggaatggaatgactgtctatctgatttgtgttacgtttaacctttaagaaactgttagattttcaaaggagccataccatttttcattcctacaagtataagacttccaagtgctttatatcctcaccaacaggtgctattttcagcctttttaattttagccattcttatggatatgtactggtatctcattgttgcactgattgatctccctgatgactaaacagtggagcatcttttcctatgctaattgaccattcatgtatcttctttttttttttttttgagacggagtctcgctctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggccccatgtatcttcttttctgaagtatctaagtcttttgagaaattgtttcaatgtgctgtttatcttatcagactgcaatatatatatatgtgtgtgtgtgtgtgtgtgtgtgtgcctgtctgtgtatatatatatacatatatatatacgtatatatatatatacacacacatatatatacgtatatgtatatatatacgtatatatatatatatatattccctatttggagataataatcttcaaaacggtgaatatatatatgtatacacacacacacacacgtttgtgtgtgtgtgtgtgtatacatatatatatgtcctaagaatcaattagacatacatgtgagtatctatttctggattctctcttctcttccactgatatatattccatttttttttcaacaaaacacataatcttgattttcatagctgtagagtaattctggaaataggtagtgaattcattcaccattattcttttataatattgctattttattattcttgatcattgacattaccatataaatggtagaatcagcttgtaaatttctaccaaaatgccggttggaatttttattagaattgcattggatctggagatcaatttacgaagaactgactttttaaacataacaactcttctgatccatgacaaggtttatctccccactaatttagttctttcataatttctcaaagcaattttttgtagtttttggtgtactggcctactggccttacataaattttgttgactttcctttttttttttttttttttttgagacagagtcttgctctgttacccaggctggagtgcagtgatgcgatctcggctcactgtaacctctgcctcccaggttcaagtgatcctcctgcctcagcctcccaagtagctggactacaggcacatgccaccacgcctagctaattttttgtatttttagtagagatggggtttcactgtgttaggcatgatggtctccatctcctgacctcatgatctgcccacctcggcctcccaaagtgctgagattacaggtgtgagccacggtgcccagtctgttgaatttatttataaacacaacatgtatttagatgttactttaaatgaaattgtattcttatttcattttccaaatgctcatgcctttctaatttgacataaagtgctacatggcattggggctggtacagcctcgctcaattatgggttgaagagtacacagagactgccaggctgagggaaggtgcaagagaatagaagagatgctcacagagaaccacagaccgcacggccccagagtcaggggcagcatcagccactgtcggctgctcatttgtccagacagagcccacaagcctcagccatgctttgcttctgcaagatgcttcttcaccttttcaataaacctgcctgaattaaagctgatgggagtttatttctccttcatcataaaagaaattcttcaccacaacaatctccaatgaattgtgggcacagaaggcagacccatccctgcttctcttccactatctcccctgtaggttgaaaaggaggaggtactgaattacctccaaatgttcctctggctctgatattctgtgactctggtttcttttcggctactttgtttttggaagcatgtatcctaaggcgtccagttgaaaaacctttgtctactgtgtccagacattcctggtggtatttcagattaagacacccttgggttgctgcactcacaaccactgaaccaattctatgaccatctgtttcatggccacctgtttgctcattttctatgtacataaagggaggggacacaacaaatttgcatattataaactgtatcatcttaaaaaggaaacaaggcaatattttgcaataaaaccttaagatgcattaaatttaagcctaatgcagtaaagaatgcccataaaattattatctaaagaatgtttagaaaattgttgaacaagggacatcatcatttaaagtgatacgaagaaaactcagctaagcatatgggctagattagagagaaaaataaaggacccatctctgccctggaaaaactactggtagcatctttcacaaagctctctgtgtttgagtacgcaccttgatccataggctcacatttgatcccaactggcggctgcttcttggcattaactttggattcccaaccagtaaatcttaccaagatctgagtttctccaggtatgatattattttgtttgaccatccttatcttcaagggctaccaagaagaaacaaatcatttatttacctccccagaggaaaaggttttaccaatgagacactttcttaccatgaccccagggcccccatgccctgttcacttgagtgccctgtgtggcctgagagaagctcatactggtcacaggattctttatatgattaacctccttcctgaatcccaactttatggtggtggtgatgacaggtatcccatgctcatgtccctgaagtcatcagcctgtctccagttagaaaaaattacatgtatatagagaagcctctttggaagtagcaaaagctttctcaccttcatacattaatggttggaatgtacaatagtataaacactttgggaaaaaatgtctggcatattcttacagaactaaacaactacctattctatgactcactaattcctaagcatttatccaagagaaattaaaacatatgtccagaaaatgatttatacaagaatgttcatagcagttttattcataataggaaaaactggaaacattcaaatatctatcaatacaagaatggatcaataaactgtgatacattcattccatggaacggctaaaggaacaaacttttgacacacaaaacaagatggatgaatctcaaaaacattttgagtgcaataggagccatacgcaaaagagtgtgagaaaaatgataaataataatggtttcaagaaatgcagagcagagagcccagaggcaaagacccacaggacagagggtcagtcccaggctgtggatcctaactaagaaactcctgctggattttgcccagctccatttccaaactattttgggttattgacttctttatcccctccatgttccctcattttgaactagaatcactgtagtggttattctatgtctgtcccatcatttcacattaggggcagataagctgtttgttcagtttcacaggtcgacagaggtaagggaattatgtcaaggatctgcacttaatggacactctcggaagcctcattcacacctggtgtggatgttttagatgggattttaaacttttgatctgatgtggtctacatgacatttttcatgttgaactaatgctttaatgacatgaaatctggaaacctcaggggagagggtaaatgcactttgcagatgggggaatgtgagtgtcctactgtggtagatggaatttctgaaatggtccccaaacatgccacacccttgtctctaaagcctcttaaggtgatgagacaccattcctgtgactatgttgttatatgccagttatatgactttaagatggtgaggttaccgcatgaactggatctaatcacatcactccatacatgacagagctttgtgtggctggttggagaagatgaagtcagagaaggtgggagcttgagaaggactccatgagttgttattggttgaaagatgaaacagacaggtaaggaggaaagcatgtggcctctggagtcagagtagactgtctccccgctgacagccagcacagaaaaagggccctcagtcccccacaaacaagaataggaactctttcattatctgtagtgaacctggaaaaatagcttgagctctaggaaaaaaacacagccagcccattcccggattttagcctcacatgactctgatcagagaacccggccacttcattccagacttctgtggtttcaaaccactggtttgtggtaatgtgataataggcagcaagagaaaactagtacaggtgcctgtctctcctcttgaatttcaatttcagataaatgtatgctaaccctctaagagaaaaaaatcaatcaaccaatcaatgaaagaactacagtaaaaatattgccctcacctttatgtggctgttccagagcccttgccacctgaagaagacaatgaggggtatttcaggcacttgaggagtgtggctttactgttatcaatcacatttctggaagaataaaaatggttcagtgaagggatgggttgcccctccacacctgtgggcgtttctcattaggtggaaggagagacttggaaaagaaagagacacagagacaaagtacagaggaagaaaaatgggcccaggggaccggcgttcagcatacggaggacccatgccggcactggcctctgagttcccttagtatttattgatcattatcgggcatttccggagagggggatgtggcaggacaataggataatagtggagagaagatcagcaggtaaacacgtgaacaaatgtctctgcatcataaacaaggtaaagaaaaaagtgctgtgcttttgatgtgcatatacagaaacatctcaatgccttaaagagcagtattgctgccagcatgtcccacctccagtcctaaggcggttttctcctatctcagtagatggaatatacaatcgggctttacaccgagacattccattgcccagggacgagccggagacagatgccttcctcttatctcaactgcaaagaggccttccttcctcttttactaatcctcctcagcacagaccctttacgggtgtcgggctgggggacagtcaggtctttcccttcccacgaggctgtatttcagactatcacatggggagaaaccttggacaatacctggctttcctaggcagaggaccctgcagtcttccgcagtgtagtgtgcctctgggtacttgagattagggagtggtgatgactcttaacaagcatgctgccttcaagcatttgtttaacaaagcacaccctgaacagcccttaatccatttaaccctgagttgacacagcccatgtcttagggagcacagggttgggggtagggttacagattaacagcgtctcaaggcaaaacaatttttcttagtacagaacaaaatggagtctcttatgtctacttcttcctacacagacacagtaacaatctgatctctctttcttttccccacagttcaggtcaggccgtggctcgtgtctgtaatcctagcactttgagaggccaaggcaggtggatcacttgaggtcaagagttagagaccaacctggccaacatgaagaaaccctgtctctaccaaaaatacaaacattagccaggtgcggtggcaggcgcctgtaatcccagctattcaggaggctgaggcaggagaatcacttgaactcaggaggtggaggttgcagtgagctgagatggcgccgttgcatttgagcccaaggaaaagagaaataactccatctccaaaaaaaaaaagataaaataaagacggttcactacttaactccaaatattattatgtgaaaatgtatcatctcaattttaatagcagattttaaaaaattccttttcttgtgctcaccagacaaggtttggtaacaaataccagtcaccagcacagatgaaccaattcaaggagagccataaacaggactactattatgtttccccaaaaaccatccctagaatgcaatctcttctctacttgtcacaaaacgaacacaatagtccactatataaagtcccaaacacaggaaaatgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattaacaatgggggacttttataacaagtaattctttaaacaaacttttgggtttctatttcaacatggaaagagctaggcagtcatcacttgtcctcacagctagaaaaaggctgaacaaactgaaagtcaacccttctagggtggatcagagaattgaggtcacagggaaaactgccaccttaaaaatgagaaacacaggctaacacacaaggagtcacagctcacagggaagagaagctactggggacagcaagtgggaggagcacttaaatggtattgacagattactagaagctgagggtagcctggctagaacattaaaaactccttgaagaccagactaagggggaatctcacacatttccaagtgttactacaatgatctcaaccaggttctcatgatgaagttcagaaaaactccctgaggtttggcactaccaacttcaggacttacattaagctacagtaacccaaatagtgtgaagttggtgaaaagagaaaacacacacatatagatgcatggaaaagaatacggagcccagaagcaggcctacatacagtccactgatcttccatggaggtttagagacaatttaaaacagcaaagatagcctttccaactagtggtgctagaacagctggacaaccacatgcaaaaaaaataaataaatccaggtatgcatgttatataccctttataaaataaatcttacacgtaaatgtaaggtgcaaaaccataagaatcctaagagataaaataggagaaaatctgagggatcctgggttcaatgatggcttcttagatacaaaaccaaaagcacaatctactaatgaaaaaaaaattaagttgagcctcattaaaattaaaaacttctgttgtgtgaaagacactgttaagagaatggaaaaagcaagtcacagactgggagaaaatatttacaaaataatctgatggaaaaactgctgccaaaatatatgaagaattctgagaactaaacaacacaaagcaaaaaaaaaaaaaaaaaaaaggtgaaagatctcaacacctcattaataagatatacagatggcaaataagcatatgagaaagatgctcaaaatcatttgttgtgagggaattgcacattaaaacaacgagatatcactgtaaacctatcagaatggctaaaacacaaaacggtgaacacaccaaatgctgtcaaagatgaggaacaaccagaactctccatagctagtggaaatcaaaagtgtacagtcactttggacaacttaagttcattcaaaatcctgcacataagtacttgcagcaattttatcataattgtcaaaacttggaagtacccaagacgtctttcaccaagtgaatgaataaacaaactgtgttgtagccatacaatgaaatctgattcagtgattttacaaaacaagctgtcaagtcatgaaaagacgtggaggaacttaaagtacataatgctagaaagaagccagtctggaaacctacatactgtaattccaactctaggacattcttggaaagtcaaaaagatagaagtagtaaaatgatgagtggttgtcaggggtggaggagaggaggaggcacgaaatggtgaagtacagggaattttcagcagtgaaactattttgcatgatgctgtattggggatttaggacattacataattgccaaaacccataatctgtgaaactcaaagaatgaactctagtgtaaactatggactttagttgataatgatgtatcaatagtggttcatcaattgtaacgaatggaccacactaatacaacatactaataggggaaactgtgtgctggaggacaggggagcctaggagaactctctgtactatccactccatttttctgtaaacctagaactgttctaaaaaataacatctattacttttttttaattaggatgcagcagccccataccaaggttttggtggcatcctgttattgtgtggttagtacttggcattgaagtgcaccaacctggagtcagagcagttggagatttcaatgcctgtgccatttacctctaaccctggggtgcccccggaacacagatagcagatcagttaggcagaagcagcctcagtcatctagacagtgcagggttctggtaaggacaggtgcaaaccatctaggtgggcagaacttggtgatgactaggaaccactgagactcagcagctgccccagtggcacccacaaatcagaggaggaggaggctgggaggacctaagggctacaggacgagctccctgcctacaagacagaagcagctccagaggttttggtaagtaatgtagatttcagtgcagtgtggtctatttaaaaaagtagaacaaaaaggaaagaaaaagagagagcatgagagacaaagaaaaagaaaagaagaaaggaagaaaggaaagaatggagggagggaaggaaggaggaagggagggaggaaggaaggaaggaagggagggagggagggagggaggcagggaggaagggaggaaggaaggaaggaaggaagggagggagggtggaagggaaggagggagggaaagaataaagagagagagaaaaagagtgggagagaagtagggaaggagagaagtagggaaggaaggaaggaaatgaacaaatttacatgaagatgagaacatccaggggaacttacaccaccagtattttccattaacaggaacacgctaactagttattggagacagacgcactactgtaaaactatatactgtttccatggggtacaaccccttcttcctcctctgaaacacataattcctctggcccactgttgccagagacactgagtcttgtctttggataagttctggtgcccaaaagaatgagatgagacagtggatcccagaacaccaggccgcaacctttcctgctgctccttgtccactccagaagctgcccagctgcaggtgggggcctcagcccctgggtctgacatcgtccatttgtcattctcactggacttccctcctcgcactggctcccactcccccaggacctggtggacggccacgtgagaaggatacaaacaggccatgcccctttctttctccccctctcaatgcctgcagtggtgggttccatggggtagtgacctgagatttactcattatggggtctctagcccagagcagggcatggtacctaatagtcaccccatgaatgctcagtgaaagaaggcgtccaccacaaggtcctggggaaccaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcctattttgaactggcattttacagtgccgaaaggatgttggagtgtttgtatacaatgggagcaaagaagattacatctagaacatgggcaatttactggagctccttaattcactagtgtccaaagataatggttagtgggaaactgtagctgtaaaggatttgcagtctattggaatgaaaattttggtcatactactagtttaaaatttctgatagggaaaggtgttggtagaaggtaaagggagcattgataggtgatttgaaaaaatgaaaaagaggagctgactatcaacatagaacatagaccaacagcagaggcagaacctatatcagatattgtttacttgtgctgattaatgccttccttccctttatcatgctgcctgatctgaagagtactggtggaactaacattacaacctaggttccaggtaggggtatgactgagttgataccagcccaccaccatacagtggcaggtgccctttgtaagtaaggaggatagtaaatgttatcctccttactctaccattgcactgctaagtaggcttttattttgctgtatttgccacctttaaaatttatccttcgcatcgtagtcataacaagtgaggtaattaatgaggcttccttaccttcactatctttcttcacctttgacatggtaaagtttattatttctatgttattggggcatatgacatttccagcctattctgtaaccctaatccacatttggtttcagtctacagtaaaatacattcaatacttacaactttttttttttgctgtattttaccaaagcatcttcctttaattggttgttattgttttccttccttctgtaaccaaatgtattgccctttttctccacatacccatgtttttgttctctcaaaaacattaatgaaaatattttttcctgaattcttgcttgataaaaaccgcaacaaattgtaatatatcatgtctgcatagtaagactagcttggctgcacataaaaatccttggttggcattgagaatcttgttggtcttccctcatgaccatccagcttcagtacagctaggggagccaggacagccttcttcatttctcctgtgagtgacttattctttttttctggctgcccaatagataccttattttttttaagtccaataccttcattaagatgtggttcactttttgcctgtcatgaatggatataccttgcttctgatgtgcccttttgaaaggtagattcaagtcttcatgcattgcatggaagtgttcttgaattataattttgaagtatttgttctgtctcttttggtttcttctttggatgttccagtaatgtatgtgttcaatccatttgtcggtcttccatagttctcattttctctgtaatacttgagttttgcttttcagatgtttgcttagataatttttgtataaatgggtatctatttccttttatttttgtaatatactactaaatggtttgggttttcctagataactacagaggttcagagagagaattaagacaaccttctgggcctcacaccagaatggctctttcctactgggctgtcacagagacagactgcttcctgcaagtatggctcctctggtgattctctgtgtggttgaatctcccttgttcctcccttgaacaaaactgggtccaggaggggactttttctggtagactgtgtaccctggttcccactcctgtggttaaaaaaaaggggtataagttttgaacatggaaatgaactcccaaattttcagggagtacattttgttggtgttttctgagattatcagccattggcctcactacctccatacttcatttactcccatgtggcttgtgcctgattccaactagatttagtcatccctacataagttttgaaatctttggattctaactttttctagtttcactaaggatatatttggttctttttttctccattttccttgttgcttttttatgtgttctggaataacatgaggaaaaatgctgacttttacagcctgtgtatacaactacctctacagaaaattttaagatatatattagttctttatattcacacaataactttgcaaatagtcctagtgtacaaagcttattccgatatcttgctgtgtttttaaacaaacatatatacatatatgctgtgatagctgatgttgagtgtcaacctgattggattgaaggatgcaaaatattgttcctgggcatgtctgtgagggtgttgccaaaggagattaacatttaagtcagtggattgggagaggcagaccctccttctatctgggtgggcaccatctaatcagctgtcagcacagctagaataaagcaggcagaagaagatggaagaacagacttgctgagtcttctggctttcatctttctcctgtgctggaagtatcctggtctcgaacatcagactccaagttcttcagcttttagactcttggacttacaccagtgatttttcaggggctctcgggcctttggccacagactgaagactgcattgtttacttcccaactttcgaggtttcgggactcagactgatgcaccactggcttccttgctcctcaacgtgcagatggcctatcatgggaatttatcttgtaatcatgtgagttgattctctttaataaacccccttttatatgtacatctattctatcagttctgtccctctagagaaccctgactaatacacatgcatacacacatgtggtcatgcagacatgtatacatgcatgcacacatatgtgaccacatgaacatgcatacacatatgtgatctttgccattgtggatggctaggatgatttttctcaggaaaggtatctgtgttattagaaaaatagccctggttctcatcctaaagtcataaaaatcaggaggtaactcagtaaaaggagacacacacacacacacacgatgttatatgtataagtgatttaatattttatatatataatcaaatccttgaaattgccctttgtattaatcagtgttctttatagaaacagaatcaagagtatatgtgtgcatgtgcacgcatgtgtgtgtgtgtgtgtatatatatacacatatatatttaatacgtgtgtgtgtgtgtatatatatatatagacagagagagagggaaagaaggagagagagggagtttattataagaaattggctcatgtgattatgggggctgaaagtctcacaatctgccatctgcagctggagacccaggaaagacagtgatgtagttgagagaaccaaagtatcgatggtataagacccagtcaagaacagcacagggggctgatgtgtcagctcaagcagttaggcagagggtgaagtcacccttcctgtgctttctgttctattcgggtctcaatgaatcggataatgcccactcacacggtggagggccacctgctttactcagtctgctgattcaaacgctaatctcatacagaaacagcttcacaggcataaccaggacccatgtttagtctgggcacctcatgtctaagtgaatttgacacaaaaattatccatcatacccagagttcttaatcaaagtttcaatgactgaggccagtcctgggcagctaatgttcgtccaatattgcgtctagttttaccatcccttccgtttgccagaaatagaaacagaaaatgttctacatgtttgcaccaccaaataatgaataagcaatcaaatgccattttgattattgaccttctagcttttacaaaacacaaaacttgcacaaataaagatactattggaagccaaggaacctagagacacatgtaaattctctttatctctgctcgatgcgtaaagtattcttatttaagagtaaatttcctcttgtttcagtgaaagatatttttaactgatatttttaccttcagcaaacacataaacggtgaaagttatcccaaacattgccattttcaatttccaaaggagcttatgctaatttcagaggcatctctatggtttatatgtatatttaatatataaggcaggtcctactatctctattttacagaagaagaaactgaagttggaaagatcaacaagcttacctgaagtcacagggcgggagagtaaaggagcagaattttcaacctaagtttatatgattctaaaattttccactaccatgctactaaaagaaattactcaactagttcttcctgttcaggtaagtcagttcagactttgctaattctgaataaaggggacagaagttatgatgctgtaactatttgacatagactgtgttagattagagatgagaggcaaaaatctgaccctagtatatttgctttcattgattccaatgtcatctttaggtttttgtatatttctttctgattttaacatatgatcctttattttcttcttactttcctcccttcctcctctctctgtcaaattgttttcctcttcctcctcttttaaaaattctcaaaatttgactataaattgctttttcttctttgctccttttcacaactctttcattgccacaaggcattcaggtagaaaaaaaggccaaggtagtctgcagtgggctagctatttacccaattgacccaccatatcttttacataagcaaataaattaacaagttatgtaaataatttatattcaaatattcagaaatgtcttagacatgtttaacatgctaccagtaaactccttttaggaggagaccacatgcagctttagaatagaaaatagaagaaaggaaaaaaataaacaaatgaaggtttttctctgcagtctttatgcaagcaacgacttatttcttaaactctcccctttgtggctatcactcaaagaaaataaagaagaaaagctactggctttctagtttaaatcacagtctcattattctgtaggtgaatggggagggggattggaatcgtaggtccgagtgggcagtaacttgaagtcaatggagatatttacaaaacagaagcacaatcacgatccagcagttctggagctgctaactttttctgcctttttctaaatgtccaataataaggttctaatggagactgaagatccatcacctgctccacatctccagggggcccatgtgtgcatcgcagtgcagatcatacatgcttctttcccctcccatggcaaggggaatactgaatgatgacaactcacatgtgtaacccaagggctttgcttgggtttgcaaggactagtgcacaatacattctttgagtgttataataacattaagtcaatgcacgaattataatccctatttcacaagtacaaaaacacattcaaagaaattaacttccttgctcaccaaacagttattgacaaaaattacaatatttatgtttcttttgaaaaatattataaagattctcaaattgtctaaccaatcatattatccgtatttgtctcttctcaagctgttaataaagacatacccaagactgggacatttataaaggaaaaaggtttaattgactcacagttcggcatggctgtggaggcctcaggaaacttacaatcatggtagaaggggaagcaaatatgtcctttttcacatggcggcagcaaagagaggtgggaaaaaggagggaaaagccccttataaaaccatcagatctcatgaaaactcacttactatcaggagaacagcatggaggtaactgctcccatgataaaatcaccttccaccaggtccctcccatgtcaggtggggattatgggaactacagctcaagatgagatttgggtggagacgtagccaaacatatcgttatcttgataagatattgctttggattgaatcgtgtccctgcaaaaatcttatgtataaaagttctgatccctgatgtgactgtttttgaagacaggcagggcctttagtaggcacttaaggtcaaattaggtcatacgggtgggacctcagtctactaggactggtggctttatactgaaagaaagagacagatgtctctcccctcgacctcacatgtataaaggccacataaggaaaaagcagcccaagccggtaagaggccccaacagacgccaaacccttccagcttcatgatcttggacttcactgcccccaaaactgtaagagaatgaaattctgctgcttatgccatccagtctgtggcatttagttacgccagcctgcactggctaatgcagatattcagaatcaaatgagtcatcccaagcaatttctcagtatatacagcacagatttcaccttctaaactcacccttgtcttcgcctttttttttttttttttgagacggagtctcactctatctcccaggctggagtgcagtggcgctatctcggctcactgcaagctccgcctcccgggttcaccccattctcctgcctgagcgtcccgagtagctgggactacaggcgcccgccaccacgcctgactagtttttttttttttaatatttatatttttagtagagatggggtttcaccgtgttagccaggatggtctcaatctgctgacctcgtgatctgcccgcctcggcctcccaaagtgctggaactacaggcatgagccaccacacctggccagtttttcttaattattaaataatctttcactgatttaagaaatattttcatatggttcctattcaggcccaggcattgtttttttgtgctgcagacaatgtgttaataaaagctgtccagccttgttagtacatcatgatatttatatttgacaaatcctctacttagatatgtatcacctccataattttttggaacacataaattttttgaaccaaatggaataaaaagctagatatatacgtataatgaatatatttgaaactttgtactttgctttacaatttgcaaaagaacatcatatacagtgttgtatttgagtctcccttaagccctattaagaagaaatttttctatttctgctgttcagtgaagaaaatgagcaaaaaaaggtgcagcaacttcccaatatcccatatttacaaacataaaggagtgggactttaaggtagactcttggtgtccacgtttgtgctctttatgcttcatgacaccaggtaaagtgcaatgagcacagcaaatgtgccccctcaggagccagctaagaccttccgggggcttctcctggaagtacagagtctgcgacccccatcctaaatacacaagcattggcatcactgcctcacagtaaaacaaaacaaaacaaaacaaacaaacaaaacaacaaagaaaaaaacaaatacaatctgttcagcagagtaattgtacataacacaaaagaacttctgggaaaaacacggaaaggatattgaagtcagaggctcagtcatgtgaaaataaaaggtcttgttgggtgcctaagtcttgtctttgctaacagctgttttcgtgcaataccagtaaacccagccaaaggcattctagtgagcaacacaggaagactcctatacacttcaattttccagcaatccataaaattgaaacataaaaataggattctatttcccttgttcattctatatcttaccagaacttatatttgcatatgtgtagaaactcaaggtttacaaagcatatccacggtctttattgtatttgatgctccacaaaatgttgcaagggactcagacaaagtcttgtttgtactatgttacaggtgagaatgctgacatgtagaggggcaagtacttacctgatcacgttgtcttagtatgatgaagcctcacttaaacccatgatctcatgtcttcccttaaactgatgcactgaaatacagtcaggtaaaataaagagttaggggcacattttaaaatacatttaaggtgcatcaaagatttaaaccaatcacttgtaacatctctatttgtcaaactcattggtgatcattagcatttagagagacccaggaaaatcgcaagattctaaataattttcaaaccatagtagaggatactttgtttactgttatttatgtattaaatatcttttaatatactatagctttataagaacagataatccatttttggaatttgtgttttaattggccaaagagttaaatccattttttctagatcctctggataattaggaatcggtagtaaaaagcaattgcacttttccaataaaataatatgctcagttgttcaaacccacattcttgataaaaacaactagaaattctgcataagatagaagaaaaagaagattttggagcaacaaagagcatacaagatggtaaggaattacaagaccaaaatctaagtgatgtcttgatctcagaaaagaaagctaaatgttgaattccctttggcccttggagaattcatgaaagcagtgaatttgagcttcagtttttcagtctctgtggagtgatatggaagaaggaaaaaatctcaagtccccagcaacacgcatgtgataatagaagactttccccctatgaaacaagacctccaaagagctataatttcacaataagcataaaccaaaagtaaacccacactacctcactcctgcttccatgtgtcggcaaggaagtgttcgttggtgctaaacaaagcatggggaaaatgctgctgttgcataaattacaatctcaaaaactcaagctataaatttagtttaaaacagttcacaatacctaatagaaacaaatgtgcagttcctcctcatcctgaaagaatctccacaataatattccaaggaaaataatgcactcacagcgtatgtatgtatcacctatatgatgtatatagctgatagataagtacatatgtatcatatatatatatacatataaccattacagagaactagaagaaatagtggagaaagaaacagttctacaaagaccctagatttaaaaataatcagagaaaaatgttgtaaaacagctcttctcataacgtccaaagctagaacacacttgaaacaatctcagcaaaagaaagctgtcaaatatgcagccataaaaaaggatgagttcatgtcctttgtagggacatagatgaagctggaaaccatcattctcagcaaactatcgcaaggacagaaaaccaaacacggcatgttcttactcataggtgggtactgaacaatgagaacacttggacacagaaaggggaacatcacacaccaggagctgtcgttgggtagggggaggggggagggataccattaggagatatacctaatgtaaatgacaagttaatgggtgcagcacgacaacatggcacatgtatacatatgtaacaaatctgcacgttgtgcacatgtaccctagaacttaaagtataataataataataataacaataataataaaagaaagctgttaaaaatgaccagcatagaatctctcttccccactgtcagacaacatttcagtggtccctgtaactattgctctggtcctgaataaaatctttctcgccatgcttgaaaaaaaaaaaaaacagaattgcaaaatatgtctctgacaaaggactaatatcaagaatctacaaggacctcaaagaattcaagaagagaaaaagaaacaaccccattaaaaactgggcaaaggacatgaacagacatttttcaaaaaaaaaatgcaagcagccaacaaacacaggaaaaaatgctcagaatcactaatcattaaagaaatgctcattaaaaccacaatgagatatcatcttagtcagaatggctgttattaaaaagttgaaaaaagaaaaaaacagaggttgacttggatgcagagcaaagagagaatgcttatacactattggtgggaatataaattagttcaagctctatggaaaacagtatgaagatatctcaaagaactgaaaacagaactaccctttgacccagaaatattcataactggacacctacccaaaggaaaacaaatcattataggacaataccatgacaatagcaaagtcacggaaccaacctaagtctaacctatgggtccatcaataattgattggataaagaaaatgtgatatatatacacatcatgtaatactacaccaccataaaaaagaatgaaatcatgtcctttgaagcaacatggatggaggtgtagaccattattctaagtgaattaactcagaaacagaaaataaaatactgcatattctcacatacaagtggaagctaaacaattggtacacatgggcataaagatggaaataatagacactgaggtttcccaaaggggagaggatgtgagtgttgaaaaactacctattaggtacaatattcattatttgggtaatgggtgaactagaagcccaatccccaccagtatgcaatatacccatttaacaaacattcacatggaccccttgaatctaaaataaaataaatattttttaaatgactggaatgtgtgaaaaaggaaacaaagaacatttctaaaatagaaagatgcaaaaaataaatttttaaatgcaatggctgttcactattttgtagtagctaaagtaggtactagtgaatccaaagatcagtcagaagaaattatgcagaatgcatcacagcaaaacagaggcagtgagacattttaccatatttttacttggattcctaaacaaagaggagaaagaacatagaacagagaaaacgtttgtaagtaatattttaagataatgactgataccctacatcaaaagaaagccaacgggaagttcctaaatctatagagggtacacaaacataaaactacacttgaacatgtcatggcgagttggacgaaccaaaaacaatagtaaaaccaaagaacaaccacacacatgcataaatccacaaggtagtgaataaaatagcttactttcaaggcagcagaatggcattgaccactaactactcaacagaaatgatgaaagacggatgccagaagaatgagatcaccaaagtgctaataaaaaataattgccaacctagaatttctaggacccactttttaagagtaggatgaaatgcagacattcttgggcaaacaaaaaaagagagtttatctgcagtatatcctcagaaaaggatgtaattaaatcagagaaaaagatgaggatcaagaaggtaggaaacatgcaaaaatcatgacaagtagtttttgccattaagaaaaagatgaaactaattaattccacaaaacaagtcaagaataactcgtgaattagagggagcagaaatggagttgccatcttcaaaggcactcgttttcaggagatgtatacaatttttggaaaaacttgtatttgaaaagttaagtatgcattttgcaattttcagagagtgaaagaatagcaacaaaatacttataaactaggaaaggaaaaatcttgaataagaaaataatctataccaaaaaagccatatttaagtactatgtttattttgttaaattaatttaaattttaaaaaattatcttcactctatgcaataatatttgtgaaattttgactctggtgtgtaaattaacttgtttactgcattgaatcctttgtcatttttgtaatactttgattatctccatctaaatattcaaacatcacctcttaacataaccagtggtacactttccatgatttagatatggtggtctgactagcgttgaaacttgagagaagctagcctcaataacaggacccagggataaccatctagttctccagcgaagggccttaagccttctgggggtccacattgttggttactcactaatcaaagatgtacccggcccctagttttctcctccctgactcaagttcatgtcattcaactctctgcctggttcacggactcatggtattctgccctactcctgctgcttggctatccaccagttaccaaaagctgaagctgatgcaaccacgtgaaatttctacaagaccctcccctctttgggctcccatcacattatcactactgccagatgtcatcagcgtgagagaatcagtggtggtccacaggagcatcttgttgtccctccctaaatgataccagcaccactttcctcccaaaatcaatgctcccaaccacaataccccccttgacttcacttgtgttcccagcaagccatcaaaactagcaccaaggctctctctaggaggctataaatatgtatgttttccttttttctgtctttaaatggtgagttaacacaaacagacctacgtacaccagaccccaaggtatcaatctggatcccttcacaggatccttttccattcacagaaccaagaaaaaaaagcaaactctgaagcccagcccttccctcctctattccggagcaggcagctgatgggacgcaaatggggctgctgagcttcagggtggaaatggaagccagtgccttgtgctccttgtgatgtgaaaagtgttgcagctgcgcagagaaacaagagttttcactggacacagtgcaaggagcaagcaggatgcctttcatggacagaagctgcatctgtctatacttcagccattcaatcaacaaacatttcatgatcatcagttactgctatgaaaggtagatgctgagggtaaaacaaggaacaagatgagaatgccccactcccatatggcacatgtaaaagcataaaagtctatctgaatcatttttgaaacagaaggcccatgacattgcctgctgagtccacattggctcttgtttgtggataccagcacatattaaaattatctgaaatattcagttgtgagccccctcccctgatatggttaggcttcacgtccccacccagatctcatcttgaattgtaatccccataatccccataatccctatttgtcaaaggagagaccaggtggaggtaattgaatcatggggatggtttcccccatgctgttctcatgatagtgagtgagttctcccaagatcggatggttttataaggggcttcttcccctttgcttagcacttctcctttctgccaccttgtgtagaaggtgccttgcttccccttcaccttccaccatgattgtaagtttcctgaggcctccccagccgtgctgaactgtgagtcaattaaacctctttcttttataaattacccagtctcaggcagttctttattacagtatgaaaatggactaatacagtgagaaaaaaaatagctctggagggctgggttacattcaggacatgtactaaatattttaatgcatttttttagcaagcacgtaaaatgtctcccccaaggctttaagctctctttctacttccctaaaggtttccccatcaaaataggaaataaatattgaagctagaaaaggcttgtccccttcaaagtaagtaagggcacgcttcatgacaggcatatctttcttcagacagtgggggaggacacttaattccttcacctaagaaaaaaaaagttacaaaacagcaacctatggaaacaaaaacatggaatcaatgcatcgcctgaaataacttccctgtagtcctgagggtggtgttttgtttggcttgttctccttcccacctttttataccccccaaggatccttctcattctgttgtagccagggctcctagagaaggctgtcaacattgaagggcccagatcccttctaccagtttttcttgtgcttcctatgtgcttgtaactgtgaatctcctgcttttcaaacaactcttctgccttttgtatgggtatacattaaaggggaaaatcagggcctcttcacactactctggcaaaatcaacctgaactgctggattataggtcttggcatctggagctgcctgcttgagccctggcaggtctggaggcttggggctctttcattgactcaggaaatatttctgcttcccacccaggacttctgttgtctcttcctcccttctcctgccctgctctcaggactcttagatgtagcccaggtttgcttccacacagttgacattggcggtgcacggtcttctcccctctacgccctcagatctccacgcctgtgcctatgacacgtgccacctgcaccggtgttgccaagcctggctcctcatccgtggccactcctgcccccacaacctgccagtcctgcctcctttttgcctgcctcctgcctatctttacttcactgatttctttggctggaaaatatttctacaacttcccctcccacactcacctggggctatgacattgttgtgggcactggttgggcctcgcccctaccacctaacaagtacatcctacaggcccaggagggcattatctgtggttttgaatttctagtgtctcgaactgtactggcccagagaggacctcaaatatggaaaactgaagtgattgctttctgcacgcgttacctatgcacccatgcataactcacacaaacttactgaatcttcatttactcttctgtgaaaggggagtaatcaaagaaatgcactttactaacaacaagaggatggcatagtttatcttttaaactgataaagatgttctgaaataagaatctatgttttcaagggtacaggactttggtagttacaccatgacagtaaagatgcatattttaggaacttggtgggggataatttgacaatacacatctacatgtttacattgtacataccctttgactgacactccactgttagaaatttgtactaaggaaataatcagacctacaacataagcacttagctataggaatactggccaaagagttgttgatcatactcaaaaattagaaacaatctaaatatgcaataagaaatatttaaaataaattatattgcattcatctgatgtaatattatacagacatttagaaagctcttgtagtcaaaggataagtaggttacctttggcatattaaatgagtaaaactgatactaagttgatatacccattgtgatataattttctttggttcttaaatatttttatatacctaaggaaaaagattaaaagcttatgaaaccaaaatattcacagtttagttatcacagtctagtgtgattatgggtaatttttattgttttaatttcatatttttctgttcaaagttccatcgcttgtttaattaaaaaaaacttttaaataatattataaaatgaccatcacagaaaaaaatatcattaggcaatattgccatgactatagacctttctccctacactgttattcttacagttggatgctttgaatcgggaagtgatatatcgccttgcttttcactggagaaggaagcgccagcctttgtgagcatgtgtatcacaagctaactagcacgaagattgcatagctctttctacataaggctactgttcgcagaaatttggtccatggtctccagtctcttggggtctcacgctctgtgaaaatcttcgtgtttttccctagcccccagagtcacctttcacacagcgtctgcttgtaaccgcggtccccacaggagtttgtaggatttctgtgccagcggtgaaggtgttctcaccttatagagcaaggtagaaactacgcagacaggcgctgttctttgggatgaaagcagggcctttggggctctttcttagtgtccccgttcggttgtagacataacacgcttgctttgtgtaggagatcggctctgccggcgcccaggggccctaacgcaattcatcgagacccgcaggtcagaactgcagtctcacctgtcttggcggaaatgcgctgcgctcctccctgtactacataagcacgagaattccactacagaagaaaaccccaggcctagtgatggcggttctgggcattttgccagcttctcccagggtgtgttttctgaccccacccacttctgatctgtaatgtcatggtcaatagaaactacttggcccaaacggaaaaggcaaggaggaacacagcgggaaagcctatggcgttccctggtggctaccccggggactgcactcatagatccgcgtgttccgagaagcctctgccatcccgaccccggagccgtgcagaaacccgcggctccaaagaaaaccggctagaacgcacaggaagcccagccagtgttcaggacactgcgagtggaagccgtacgtcccacggactgatctagtttgctgaagacgagccatttacttctaaccccagcagcggacattgccttgctcaaatataaaatatatgaaccaagaccgaaagcaactcttattgcgttactgatgagcaaacgggtttttagaatggttaagaaatgtcccttgttttgggaccgtcatcactaacgtatgcttgggattcctgatcgaggagcttctgagcaaagcagcccaccaatccagtggctgagaacggcttggatattggcttccaggcgcatcagaaatactgaggttctgacaaagacgtgagcttctgtctgcctttgggaaggccttcttccagtcctggcgctgccgcttgccttctgtttgacctgggaccaggtccttcaatttgctaggcttcaagttggaaagtgttacaggaaaataataatacgaagtacttcttagagttattgcacagattacagaagatagtctaatagtacagctagcatcctgtatggcttacattaaggatttgctgataggaaacaacatcccagataaagttttttccccttaattatgaaatataacaaaggaaattgtgtagacttatgcttcaggcctctgtaacatttgaatgaattttgcacttgtgaaggtgacatcattttacaaaatcagttaatactaaagaatgacaagtggaatttacaaaacatatattcacaaaaagaacttgttcttagcagctttgtttacaatagtccccaaactggaaaaggttcatatgcatcaagaggtgaatggacctattgtgatatattcatccaacggagtactaccctcaataagatgggacaaattatggaaacatgagatagcatgggccaatctcaaaaacctcatgctgagtgatgaaaagagtgcattctatgtggtgccatcaagatgaatttctagaacatgtgaaactaacctgtatagtggcagaaaatacatcattaattgctggggtcagggagtcgaggggactgactgcaaagggcacaagaggaccttctggagtagtagacatgtcatcaaacttgaaatggatgcagtgtaccatattcaaccaatgccttaatcaatttgattgtaaaaagtagtaagaaaaccactgcaggctggacgcggtggctcacgcctgtaatcctagcactttgggaggctgaggcaggcggatgggaggcggaggtcgcagtgagacgagatcgagccactgcacttcagcctgggcaacagagccaaaaaaaaaaaaaaaaaaaaaaaaacctccgtctcaaaaaaaataaaaaaaaaaaaacacagcaaatcataatgcattctacttaatttaatgtatgtttagctttagaggattcctttagaaaagcgtctcgctaaatgtgattgagagttcaggaattccttcatttctgtttctgtctctttgtcttcagttaaattcatgcactattaaatggaatatttgtaaaataaaaatagagtctaagttcaattttacaaaagcatatatataatatacagctcccatatatatgtgtgtgtatatatagagagagctttatttattgtttgttttttcttttgcgggggtgcgggggggacagtctagctaaaatatacattcttctctctgtagatataccagaagaacatgactcgatcagtgttgccctaatgttaacaaaagttattttgaacttaaggtgatcagaaattttacctatctgtactttttctgtattggtggtatggtctatgctaagcgtgtataattaaaaaaaaagagagtaacttcaaaatgatttggaagaaaaaatatgtacatatgtgaatagtacttaattccaggtgatgggaatatggatgactggttatcttcttctttctgtatcttttatatttttaaatggaaaaactcaacgacctggaagtgaaagaacagatttggaagaggtgtggggcaggtgagaggaaaatgcagagtgaaactctgtctcaaaaaaaaaaaaaagttacttgtaataaaactcaccaattttaaatctacgatgtaaccatttaaggaggtttgtagaattgtgcagccatcagcagagtcacgttttagaatatttttgtcatttccccaaataccctaaagcctctgcacagtcatttcctaatctctggtgcccatgactgggccccaacaaaataaaaatttggaaatccgacatcattaaatttcaaattttcttagattgggattttttgtagtgaatcattgtcttacttttgtgacatttgaggaaatattgcattttagggacttttttgatgaacttaatagtcctgttcattgctcttcgtgaattgtttcatttttaccgataactgatagttgctaccaaacctggtctggcaagcctaaatgaatgagctaaaaaagaaaaaaatctgctataagaaatagagatagatgatgaatttgcacataagattatgtggagttagtattgtaccatctttattctttcagaaatttggttggtaacattagagatactcctcacatgcttggaatgcctctcattatcttcttcaggttgcaagggctccagaatagtgacataaaggtgaacgtgagtgcaagatttttgctgtagttctttgctctttaatttttttctcttagagggattagcttccatgtatctgaaataataaatcaagagtagagataggcatctgtaccagttttctattgctgcctattaacacatgcaacaaactagtggattgaaaccacagaagtctggaacagaggctgagttctctgataagggttttaggaagctgaatccaggtgtgtctggctatgtagttacgtggagctcaggctacttctccaatttcacttcaggtataggaggaattcattttgtgggagttgaaagactggtttttctttttctgtgctggctgtcccaataacagctcatggagtccttctcaagctcccattcttcctgacgttaccttcttctgacagctagagaaaccactggcatgtatgcagtgatgtgattagatccagtttacacaggtaacctcaccatcttaaagtcgtataactggcttataacaacataatcaccagaatgatgtctcagcaccttaacaggctttagagacaagggtgtggcatgtttggggaccatttcagaaattccatctaccgcagttggacactcacattcccccatctgcaaaatacattcaccctctcccctaaggtttccaaatttcatgtcattaaagcgttagttcaaagtgaaaaatggtatgtagaccacaccagatcaaaaatttaaaatcttatcttaatcatccacaccaagtatgaatgaggcttctgagggtgtccttgacataattcccttccctctatcaacctgtgaaactgaacaaacagcttatctgccctcagtgtgcaatggtgggacagacatagaaaaacgattctttttttttaaaatttttttattatactttaagttttagggtacatgtgcacaatgtgcaggttagctacatatgtatacatgtgccatgctggtgtgctgcacccattaactcatcatttagcattaggtatatctcctaatgctatccctcccccctcctagaaaaacaattctagtgattcttgttcacaaacggggaaagtggaagtaacaaagaagtcactgatccaaaacctttttgaaatggggctgagcaaagtccagcaggaattgcgtggttaggatccacaacctggaactaaccttctgtgacatggggctttgcctctggagtctgcatttctttctatctttatggcaatcattttattttccttcctctcctactcccttggttcttcccctttctccttatggcagcatcctccccttaatccttggcacatcatccccagcagaattggtcaaatgttgcccacgtcacggtcctgaccatctccatgaggggctgtccttgtgaccccctgctcccctgggaccctcttcactgacctgacctctctgtcatgattgctttcagctgacctggctggtttaggagaaaacctagaattgtggagacccagaaccaatctctgccctctcttatctccaagagaggaagaaaataataggtatcaccatggagaaatgacccacatgagggctgagactctccagcagttagagcagaggaaactccctgaagaagggaggagctgagatcccaggctgggagagcaggcttgtgttaagcattacttaatctttaattgctccctgcctgaatctaccagccagcgaatgacaactgactgagtataaatactaggactacagaaccgtgataaaaggtttgtccaaggaaaagcccttttactttatttgttttcacagtggaaattgctgtttttgatccaaagttttctgaaacgcagcagtgagttcctggtgggtgagttaggtgctttggacctggaggctgaggccaaggcttgtgtggtcgatctgctgccaccatgtggtgagggagcctgggagagtcttagtctttcttggcttcactttcctcctcagtgaggtaggggcttattgttcctctctgaggtcgcttcctactgtgttttctctgagtctctgaggaactgagatggtttttatttatttatttttttccttccctttccctccttctttcgtgtgcccagctgccaatcaagccacccacctttccatttgctggggaagggggcggtacccaaccccctctattactagggggttgttatggtaactccccacgcgagggctgggtggcctctagataggacgggctgtccacccacccaattgctatggcaacagtggagccgctgagggaggggccactccgtgagaacttggctggagaaaccacgtgggagttggggggcagaggaggggcaccggctgcctcaggaatgccctttccaccctcacctagcaggttggggaagcatcgaggtgctctcagatctcaggataaggaatcctaccgcagacgtgtatctctgcacctcttttaacgaagtgttctgcacaaaggaactgtttccacaattattcattgatcactggagtcgcgcgtggaggaaggggtggcgaaggggaagagagggaatctgcgttcagtcccttaaaatattgcttgggtcgccttagatctagtcatgttggcatagcgcctacagccattagcctcagtggaggctgggtaatgctatctaagaaccacgagtcatgttctaccgctgaaatgctgtgtgaccttgagcaagttgctttgcttctctgaggttttctttcactgtgaaattgaggggggaggctgtatgatcctcaagagctcttctagcaccaacactgcctctgaaagactccaccaccagccttaatataaacatcatttaagagagtttaatttagaagtccttgaaaaatagctgaacacattcctttctggaccctttttagcatttgggtgcacagccagtcggcccccttccctaacccctagcccattttccttgccactgcccttattccagccgctatccccattcatctcctatttggccttccggcctgactccttcaagtcaattctttttttttttttcttttttcttttttttttttttttttttgagacagagtctcactccatcgcccaggctggagtgcagtggcgcgatcttagctcactgcaagctccgctttccgggttcacgccattctcctgcctcagcctcccgagcagctgggactacaggcgcccgccacctcgcccggctaattttttgtattttttattggagacggggtttcaccatgttagccaggatggtctcgatctcatgacctcgtgatccgcccgcctcggcctcccaaagtgctgggattacaggcgtcagccactgtgcccagcctctatttttttttttaaagaaaaagtctcgctctgtcacccaggctggagtacaatggtatgatctctgctcactgcaacctcaagcttcccggcccaagctatcctccagcctcagcctcccaagtagccaggaccacaggcagtgcatgccaccacgcctggctgattcttatatgttttgtagagatggggctttgccatgtcgcccaatctggtctcaaacctctggccccaagtgatctgcccgcctcggcctcccaaaatggggagattacaggatcccttgaggacaggagttggaggccagcctggccaacatggtggggttttttttttttttttttttttttgagacagttttagtttagtttagttttttgtgaatttgtgaatttgtttttattggggaacaggacacagggtggaaaatgtcaccttggtggagacagagttttgttctcattgcccaggctggagtgcagtggcacaatcccggcccaccgcaacctccacctcccgggttcaagcaactctcctatctcagcctcccgagtagctgggactacaggtgcacgccaccacgcccagccaatcctttgcattttcagttgagatggggtctcaccatgttggccaggctggtctcgaactccccatctcaggcgatccacctgcatcggcctcccaaagtgcagggatcacaggcgtgaaccaccacaaccggccaagcctggcagacatggtgaaactctgctgagatggtttttaatgccacccaggacctgcagctgagacctgactctgtgtgtctcctgcaggagcctgagctgagtccacacactggaagcccagaactgagggaacagatgaaagaaagaaagtcagcaggtttaggggatgagaacaactcacaaaggacaagccattggtaaatgaaaaccaaagaaggggggaataaggacaagttgggatagaagcctcaggggaaatgggcaatgcctgtcatcatccaaactctcaaggagcagcgcgagctgagcagtggggactgagagagaaatttactccacaggagtctcctgcccctggccagggagagccacaggctggatgacatctggtttatagtgaggggcagcagcaactccaagagggggaagatgtgaccatgagccccgccccagacccaggaggcttgaccttggggctgccgtagcagtggatgctcttcaggtcagtgtgggttagagggaataaccatgctgggagaagggttggagacatccattcttatgttaaaaagctctgccctaggtcaggtgctagagtaagtgtcccttgctagtatacaaagcagtgatacttataatattcttctgtacttacagttgaaggaggtttccaaatgatatctcataaatatttattggtgtttaattttctttacgctgtgttaaacacttgggattcagatattaatgtctccccaaaggaactcaagcccatgagagaaagaacagaaatatagctttttaagaaaatatgaaagttcccccacattggggtgctgtggcaacccatagagtgggagtttaagtgaagacattgctcctaatgacagggggaatcataagaggacttcttcagaacagactcattttcctccaatgtcccacagagagggatcctggggcatgaatggtgtaaggcaagggccagtctaaggaaagggatttgctgcatcctgggagaaatctcagcctccctgacaggatatttgggacaggaatgcaggtgagaggaggtttgcaatcgcttttattcaataattgatgaacactctcctgagaactcccttagtgctagaccctgagctgggaaccatgaacacagagattagcaagatatgatctcagctttgacagaactctcagtctagtgaccagcgattcctgagaagtatggtgatggtgggttcactggaaccagtggcccatgctgcatggagatgacctcagtggatggcctggtctctcttctgtttttttcaaatagctgaatgacctatcctgggcccgtgaccctggacttcagccagatcagcatctcaaggtacaaccaacatcttggctccatgatgggtcaaaacagttaacacacccaaggtattcaaggtatcagtagctactgactatgtcctggccagctgtgaaaagaaaggggtgaatttaacaagtattctaaaattgtccttgacatagtaatcacagattatctatcttctgtctggtaatatatatatatatatatatgtttttgtttttgttgttgttgttttgtttttttgtgacggagtttcgctctttttacccaggctggagttcaatggcatgatctcggctcactgcaacctctgcctctgggttcaagtgattctcctgcctcagcctcctgagtagctgggattacaggtgtgtgccaccacgcccggctaatttcctatatttttagtagagacgggttttcaccacgtcggccaggctggtttcgaactcctgacttcaggtgatccacccacctcggcctcccaaagtgctgggattacaggcgtgagccaccactcccagcctctgtctggtaatttaaatgctttggagactccaagattcacccatgtccaaaataaattctatatcagtcatagtactagcatttagaagttgtgtgttttatcctctaattatagatgaaatacctaaggtggaaaggagtaaagcagcttccatgaatgtagtgagaatgtaggggggttagggactaaagtcctgccttaggattccccagcagttgccagtcacaatttttgtactcttagaaacaacaacaacaacaacaaaatgacaacctgttttgttcctctgcttaccctatccaattctctacaccataacatctctgcttatcaagacaacttggattctcaatttgttgagctcaacaaatgcatctcttgagcccctgtgggtaaagcattatgctagttatggcgggtgatacagaggaagcacagaagagtccttagtgacaagagcttaagatttctgctctcagctcagcctgagttgcctgcaggtgagaaaatcagtagccgacacccacaggtgcattctggtgaaagggtcgatgataatgaatagtggttctgacagggctgggctcttaacctcccaaagatgctggtcaaacagaatctggaggatctctgcacatagtgtctgactactgactgtcataagtgaatgtcgccaagtcttggcctggatcccctccctttgtttcatttcacagattacatgttgacagcaggaaaatcaacagaaagaccatgaggctagactccaaaagacttagtaatgctgctgggtgggccatgaatttttaaaaacacatgaagggccttctcagaagtgaagttttaggaaatataaaatgcatagctgggatacattatagtgtactgatagaacaaatattggatatagcagcatctaataacttctggaggaaaaaatatttttcacattactccaattatggccttatatgacaaaaaaagaaaaaaaaatccctaagagaaccactaacatccactggttttgtagaaacaggatacccttagtgcacttaaagttggaaaaatggctctgcctttagggccatgcaatgaaacagactgtgtggtagttgacacaggaagagcagagcagagtttataacaatggccacaagacagttaagaaaatgctttggggcttttaagcagcagataaggtgactcagaggaatgttagacaatcgcagaaaagcaacttcagcaaagtttttgattcagtgggcactgcatacttagtccatgctctgcatctgttctttcacagtctgtcccttcatcgacttgggcctacaatgacttttctgggaggggagagggatcaacacaacagcatgcacacacctgaaataaagaatgaatttctgattttcagattttagtctctgacataaccaaagaagtgactaccatagatgttaactttttttttttattattatactttaagtattagggtacatgtgcacaacgtgcaggtttgttacatatgtatacctgtgccatgttggtgtgctgcacccattaactcatcatttaacattaggtatatttcctaatgctatccctcccccacccccccagatgttaactattaataacataaatgatgctcacaaatatgcagatcttataataacgaggtaaaatagcttaaaaaatagatggtagaactgtagtccagggacactaatagaagtgacccataacattacatcatctccacttccaacaaaaatcaggcaaaagaaggaaggagactggcaacccaatgcacagaactatatataacaggcatactagttattggttggttataaaccagtgggaataaatcttttttatatactgactcttggtttatgtcactgaggcacagcatggaacaatagaaaaccggactgtaagataaatacatttgagtaactggacttttgtaaaccattagacagacatttgagaaaccaaatttaaagctgtttgtgagccatgttagcctatcaaggttgaaattcaggagagatacataacgaaaaataaatgcttttttttttgtgacactgtgatctgatgcattgggaatgtgatcttgtgaatcactcaggtgagcaagcctgacatgagtgggcataaaggtcagtaactgaagaggtaccaaaatgtgctacatgtgtcaattgtgacctaaagaactgaaggcattcaccctcccttgaagtaatgaagctgacacagcagggggctgcaaattccactgcagatcagggtcttgaagctgacatactgaagagtggactcccacttgagatacagagtaggaactactgtttcctacggctactgaatatcccacaaactaacctcctcagcatgccattattaattattttaaagctcttaaaggtctcattttataatagatcacatcagaaggaagactaataaggatcaggtacaaactcatacttgctggacatatcattgcatatcatccccaagtttttggcactacataatgttggaatagattcttgaatattaaattttaaactaagggagaacattggcttctaaattttacaactatagtattgcagctaaacacaagtgcagatgggcagccttataactgcatgagtaatcttaaggaaaacttattggtgaacatacagaacatttcacatgcatttgtctacaaaggacaaactcttcccaacctcagaacttgatatgcgttaggacattcctctcccttgggctggtgataaagctccaattgaaatgagaaagattcttcatgcctggtaaatacgcaagtttccaaagatattgccactggccaatcaaacctgaatccaaaaagcatttgtttctagcaggatataagatcaatatgcaaaaataaattgtgtttatgcaattgcacagcagaatttaaatgtaaaaggaataccatttacaataatgtcaagtgtataaaatccataaatgtgaatatgactgaaaattagagcatatttcacagagaacatagtgcaggcctaataactggaaagatattgtttgctcatgtgtaagaatattgttgagatgttcatttcccctaatttgatctatgaattcaatgcaatccgactcaaaatttcagcatgcatcgttggtagaaaatggcagctgattctaaaattaacatgaactagcataaccaaaatgcctgtataacgaagtgcaaaattggagggctagctccacctgatttaaagaacaatcacagagttgtaatggccacaacagagctttggtatgtgatcaattaaatggatcaaaagaaaatagagtccaaatataaatgaacacatatattgagaacagatttttgacaatcttgaaaaagcaatgtatttaaaaatgcataatatttcaacaaacgattgaagattttctttttaagcaatggatgtgacatatttgtaaccatataaaaataaacaagtagaaaaaactgaattcatgtgtcatatcatatattaaaattagtggttacaagaggctgggaaggagataggggagaaggaagaaaagatattggttaatgcatataaaatatagttaaatagaaggaataagttctagtatttgatagtatattagggagactataactcaaaataacttcttgtatattttaaaataactagaagagaggaattgggatattcctaacataaagaaaagataaagttttgaggtgacagatatactacttacactgattcgatcattataaattgtatatgtttatcaaaatatcatgtgtatccccaaaatgtgtgcaacaattatacatcaattaaaataatgaagagtacatcttagacaaattaacaatgattccaatcccatcgagtaccttttctgaccacaatggtatgaaactaaaaattaactacataaggaaaactggaaaattaaaaaatacatggaaattaaacaacttgcctttgaacaactgattgatcaaagaacaaatcaaaagggaaatttgaaaatatattgaggccaacaaaagtgaaaacaaacataacaaaatctttggaaacagcaaaaacagctcttaagagtcaagtttataaccataaatgcatacattaaaaaagaagaaagacttcaaataaacattacacctcaagaaaccaggaaaaaaacaacaaaataaatccaaagttcactgaaaaaaggaaacaaaaatcaatgcagaagtaaatcaactgaagaacagaaatactacagaaaaataataaaagtgagttgttggttttttgttttgttttgttttgttttgttttccttttcctttctctttctttttctctttttaggagagacaacgtcttactattctttccaggctgattgggaactactggcctccagtggtgatgcaacgtaggcctctcgcacccgagttgtttttctggaaaaagtaaaattaacaaacacttggctaaactaactaagaaaaaaatagagaagactcaaataaataacatgcgaaatgaaagtggaggcattacaacagaagcctcacaagtaaaaaggatcataagaaactattattaggccgggcgcggtggctcctacgcctgcaatcccagcactttgggaggccaaggcgggcggatcacgagttcacgagatcgagaccatcctggctaacacggtgaaaccccgtctctactaaaaatataaaaaaattagccgggcgtggtggcgggtgcctgctacccagctagctacccagtagcgtgtagtcccagctactcgggaggctgaggcaggagaatgacaggaacccgggaggcggagcttgcagtgagccaagatcctgccactgcactccagcctgggcgacagagcgagactccgtctcaaaaaaaaaaaaaaaagaaaaaagaaactgttattaacagctctataccaacaaattggataacctagagtaaatggataaattcttagaaacacacaacctaccaggattgaatcaagaagaaaccgaaagcctgaacgaccaataacaaataaaaggactgaagaacctcccaacaaagagaagctcaggaccaaatggccacacagctcaactcttccaaacattcaaaaaagaaccgggcgcggtggctcacgcttgtaatcccagcacttcgggagtccaaggtgggcagattacctgaggtcaggagttggagaccaccctgatcaacatagtaaaaccctgtttctactaaaaaaatacaaaaattaaccgggggtggcggtgcgtccgtgtaatcccagctacttgggaggctgaggcaggagaatcgccttgcagtgagccgagatggcgccactgcactccagcctgggagacggagcgagagtctgtctcgggggaaaaaaaaaaaaagaaagaaaaaaaagaaaacgaaaaccactgcaaatcataatgcattttgtccactttctgagaatgtgatttcctcttcctgtggaaacagcaataatttttatgagggggtgctgcccggaccccactggaggagtgggtaagatgaggattgtgctcggtgttgcctccctacagaaccacacatactgatctgtaatacctgtggcccctaagtgtccgtgaagggactggtccctttacaacattgcgtatggctgcggaaacccactatgtggcaacaagatgtatatgtgtgggttggtggtaaaaccattataggcaacggaaattcaaaatgtttcagaactcttaaaagttcgcctcatgtagtatttggtttcttgcagggggccccaagcccccggggctgtggtcagctacctgtcctgggcctgttaggcaccaggccgcacagcaggatatgagtggcccgcaagcgagcattccagcctgagccccgcctcctgtcagatcagcggtggcattagattctcatagaagcacaaaccctattgtgaactgcgcatgaacgggatctaggttgcgcgctccttacgagaatctaattaatgcctgatgatctgaggtggaacagtttcattccgaaatgatccttccctcttttcacgtcccccacccctggtccaaggaaaaattgtcttccacgaaaccagtccccgaggcaaaaaagtttggagactgctggtctacagtgtcccaaaacccttttctatggttccttcccaaagcctggaggctctaagtcctcccctgttcttatactcctgtgtgttgagaaaaatagcatttcctatgctctgaaggttctccagaacattctttctaggctgcaggatggagattaataataacagaatatttggcatggccttgttagccaatccaaagccctctgggctgaagtgggggtttttcacttcagggtcatccagcctgggtaccttccatctcagcatccccaggcacagacaggaaggtgacatcaccccatttacatgatgtctgtctttgtggcctgggccactgggtggcttacctcagaggcggagatgtcagagatgggtgttctgggcatgattaacaaagggaaaactgagagcgttcctactgaagccccttctcctttcagctcccacccaggtggcctgtcctcacgggccttggagtggagacttgagccaccaactgtcagaggtggagacttcacaggcacagctggagccaagaaccctggtgcccaattgtctgtgactgcaactggatcaagggtttgactgtggctatggcttagccaggcaggatgtttcctccaccacctgcagcttcacaaccaacggtgatcctgggaaccaatggcccttccaaggtagggaaggaaaggggaccaggaagctctcatccgggtgtcctggtcatggtgctgtgaggggaggaggcaatggggtctcttcgtgctccctcagagtcaagcagaaatccacaatgttccaacccagtgaggtgagcaagagcctggggtttaggatcaaatctgctctcaggtcctgggcttaacccttactcattattcatctcggccaagttatttgtggtgttggcatttacatctcagtcctgtcatctgagagacctgaaaaataatatctacattccatcattgttgataacattaattatgataatttccaaagggctaattcagtaaaaattgcttaataaatctatgaatagatgttatctaattctgttatctttctggtaagttagcactcaggaaatgacttcacgtgcattgtttcaactgaggaagagtaactgttaggatctctactttctagagactcccttcctgtgtttacttagaaagtatcttttgccagttttctttctcttcctcagcatccctttttaagtcaatttcccccggtcatgcacttcagtaacaacctattaggcacattagtaaaagtgcaaatcctgggcccacaagtcagtctcctgacatacccagcttcttgctctgttttctcccctcgttttgaaataaaagaatgaaagggcaaccttctcatggaaagggtataaatctgtctcttttatgaaactccatttagttcatcatctccattcatgcccacggccatgtcctcagttttcttctcacagggatccacttctgcccagatttccttaaaaccctgggttgtgttcatccttactctccgtcccactcaatatctactcctggagcccctggggctgcctggtgctcatctgtcaatcgatgcccccagccgaggaataaggagacccacgtcctcaggaggagggagggtcacgtgagataacgagcaccatctgggtccatggagaggacacatggaaaacgctcagtgagtgtcgggggatgcgtagtccctgacacgtgccctgataactttgagtatttaaactgatttcttcccactggtgtctcttttgcttctccatggattcctgcacccctagtcaggactcaccccgctggctccaacactcttacctgctggctttcccaggagtccggatcactaaccaggttccaggcaagaggacagagtgaatgccttttgtttcattgtcctttacctggtgacttctccttgctgtctaatagggcatttgtttctcaccatgtcttctctctctcgttcatcttatttttctaaaattttttccagtttcagtggaccagattataatgttagtgattataacgctaattcaacatcttccacatccttatgtaacaatttcttccaatagatttatatatataaatatatgcatttatgtcattggatatatatattatgcatatttggcatgtatttttaataaaatgtagatatatgctacatacatatctgcatgctcatttcatcaatatctcatgtttagtctatccaattcttttctctcatatgttcatttaatgttgagttttagaatctcctccctcccaaaacacagcctgtatccagtctgacttccttgcctttgccttatctacctggaaactatttgtgtttattaatcctaaattttttgaatatgtttgtcagttgggatcaccttttcctcctggcaatcttgtcattactgggtgatgcatgaaaaatcaacaatacagaaaataccaaaatgtctttcctggcttccctttacccgttggactttctcattcaagaccactttccttctctgatgatcctcttgggtggaagagaaagtcacagtaagatcatggatgacagtgaacactgttgggtgtggtttcattttcagagctgggtttagagccttcccttgaatgaagaaccctccccagctggaaggtgatgctattgaaggctcagctgacaacatacatgggcatcaagtcattggccacattcatgcctcaagtgtcctaaaaccgaagatgatcaaaagaaaactgctgttcagcaagtggagactggcatgcagattccctggcctgcaagcttagagcaggaagataatcacatctatggctcttagctgcactcactccttattcctctctgtctatgatgacagctccttctcccactgcttttttcttctgtatttgttctctccagcagctgctgtcacctctgtctggtattacctctgtgtcccatgggctgccatgctgccaggtccttctgatccccatcccctgaactctgctctctgaactctgctctgttcccactgctgttgtcctaagagtccctctcatggccgcaggagagcccaacttccttgtccccctccaagtgcatggtgtgagctgctaaacacagggttctttgcctggaattgcacggcttgagtaatttgcctttcctttctgcatcccaaactccattgcccctttctgccaggagcattgctttaatacgtcatttacacacagatttttctcttgggacagcttttgagcaacacaactaagtcaaactgtaaccctcaccttgtacatgggaatgagaagtgttaaaactgagcactaagaactccaaatcaaaaactaaattagaacctgggtcacagacgagagttccctactagcctggagtcaggtgtgtcttcatctctagatgggcaaccttatgccagcgtggatgaagtttccagggactgtgtctgctcttcatggagtcacttagctgacattaactggagaacatttatgacattccaaagggacctcagccaaagatagatgcagagggcagggcaggactttgaacctgcgtagaccacaaagtgcattctcacctctgtcctttttattcacgtatttacttctacaagctcagttagagtctaaaacacaactcaggtgaatcttgaggacagagaaataagagagcatttaatgaattaactttgagaaaagtgagttcaggggccagctttatgtctacacaagatgatagacaagaacctatctacaggacagactttgcctcagaccagcccaagtgagagatttaattgaaatagtcagaagaaagactaaaatccacagagccacagagaatgaaggcaatcacgagagaaatgaggggataggaaagaaaatgatgagaaatcaggttggttcattcattgtctctaaatcctgctaccatgtaataagcacctggtgagatttcaataaagatgaatgccttgaactgacatcttgagattctcacttaaatggtctggggtgtgatgtgagcatcagtacctttaaaaaacttccatgatattctaatatacaactgaagatgacaaggaccactggtctactctgacctcaggttttcaacatggagatgaccacttgtgtggctactccacacaaaaggcggaatatccatcagacattgatgggatctgtattcacctctcaacagtagtatttgtagaacgtagaaaaaaattaaaaagaaaaacaagaaaatagatggattagacctgtagtctctctacttaaagcacacttgcttaattttgagtacaagtaaaataagaaatagtcattgtattgaaacccagtatacagaaaacaatacctcgtatattactcatattcagatttagtattttcttttaaattttattttattttattttattttatttttaagacagagtctctctctgtcacccaggctggaatgcagtggcgcagtctcggctcactgcaacttctgtcttgcggcttcaacaattctcatgcctcagccttctgggtagctgggattacaggtgcctgccaccacacttggctaagttttgtattttctagtagaggcatggtttcaccatgttggcaaggctggtctcgaacttctggcctcaagtgatccatccacctctgcctcccaaagagctggtatttaggcatgagccatcatgcccagccttcttttcaattttaaaataaatcctgcagtttacatttccacacactgattccacagcccatgaatgggttcggcactgcaatgtaaaaattctgctttgctcaattcttgtcattcagccaagtcctcagagagaactcgtaggtctcactccactagacagaatataataataagtaaaaactgaaacttggccgggcatggtggctcatgcttctaattccaacactttgggaggctgaggagggtggatcacctgaggtcaggagttcgagaccagcctgaccaacatggcaaaaccctgtctctactaaaaatacaaaaattagccacgcatgatggcacatgcctataatcccagctactcgggaggctgaggcaggagaatcacttgaacccggaagacggaggttgcagtgagctgagatcacaccactacactccagcctgggtgacagagtgagactccatctcaaaaaaaaaataaataaataagaaataataataataaaaaaactgaaactcaggaagagatgatatatgaatacttttttatgctacccttgatgctggcaagaaattctaaaaagaaatctttcccaacaaaccactctgggaaaaatgtaacagggagaggagaatgtaataaaacacaaactaatccttttcactttctacttcagagttttgttgatcagatattgagcatgtttctagaaatgccttaaggtgtaaccaggtgtggaatcaacttcagggaattagggataataagttgggccatggttacaatcaccacccttcctttgtaattccatttgactctttccttttcttctgatcctttttggaagaacacataatatttcttttgtctttttctcattttttattttaaccaacaaaacaagcagcagtgacatcatatttctttgtaaaagctcattcctatcctagccaaggtgacccagcaacctctagtgactgtcgagaactccagattggagaattgactctcccttctctctaacttattgaaagagacttcgtgcgtgggttctagtttcagggttgtccattgcaagtcatgtggctttagttaagtcagccctgtggcatcactgctcctctgttgtaaaaggcagaactggatgtggatgcggtctgaggtccttcctgtatctcacctccagggttcttcccatggccctgcgcacccttccctaagagacggggacatggagttgtaagggagtgggtttctctgcaaaaggtcctttccttctgcagccctctgtttctgagctttcatggttgatgctgagaacatcctcactgaggggtgtgaaaagccattactctgctccagacactggggatcaggaggaaaggggctgctggttgggcagagctagggtccctatatccttcacctcaagctgactggaagttcaggggtgtttatttttcacttgcggatggcacttgcctcttcactcagcctgaggctcacccttcagctcatcctcctagcaggagctcagtttgcccctgggctatcaccacttaacagtccctctagactcagccatcagcaggacctgacaaagatgcccatttgatctttccttctctctctcctacagatactaaatgctgctggaacaatgaaaagaaagaacggatgtcacaaaagcattttcatttgatgaatagaactaaaagagcaaagcaattgaaagctcaacacaacacaggagggatccatggctgaggattgtatttcagaaccactgactgctcttgacaattgttaacccactaggctcctttggttagagaagccacagtccttcagcctccacttgataccaatacttaggaagaccaaagccagatggacaaacagcattgagaggctttagccctactcctctcagcttccatcctgtagagaacaggagtcaggagctgctggcaggagacagcatgtcacttgggactctgccagtgcagaatatgaacaatgccatgttcttgctaaaaatgcttagcttgagtttcataggaggtaatcaccagatagacaactgcagaatgcagaatactgagcaggacaataacctgtctccttcagacagtccatgtcaccacgaatcacacaataaaaaggagaaaagacattttgggttcaaaaaaactaaaaagataatgtagctatatttctttagttattttgaacccaaagtatctcctcatctttttgttgttgtcattgatggtagggacatggacttgtttgtagaggacaggtcagctgtctggctcaatgtcctacaagagacaggggggacatggaagcgtacagctatatttgtggattagtctagctatctgttcagtatttaaagttgttgttgcatagatatttatgacttttgtcaggggagggtttggtggattggtcctttcatcattttataacgtccctttctctctctgattagtttctttgttctgaaatatactatatctggcattaatatagccagtcttcctttcctttagctaatgtttgcatgatatatctttttccatccttttgatttcaacttgcctgtatcatcatatttgaaggtagtctctttgtagccaggatgtagttgggtcatgtccattaacctactctgccaatctctgtcttgtaattggtgtacttagcccattgatatttaatgtgatgattgatatggtagggcttaagtctgccattttatttttccttttctgtttgttctctctggtttcattttctggatatgctttatttttcttacctgctgtggtgacttgaacatctttgagaatggtgttttgccttatccatagtattttttagtatatgcgtttgtatagccctcttggtttttccaggtatatatatatatatatttatatgtctgtgcatctatatctgaccacatggtatactggtgtcattgtttcaccagttgagtgaacgatagacgagcaaccttctatataggtctctttacccttccagtttataattgtttccaacattttctgtatgtagagttagaaccacatcgaatggttctatgattttttttctgaaaccgtcaagcatagtttagaaaacacaagaggagaaagaaggcctattttgctcactgttttttaaaattttctttctgacatcccaagtttccttctttaatcatttcctttctgtctggagaactccctttagcctttcttttaaggcagaactgctggtcaaagattcccttagcttttcttaatctggaactgttttgatcttccccttaattcctgaaagatgtttctgttggacagaggagtctgggctgacaattattttctttcatggcttgaaaagcactgcacaacttctttctgcctccatggtttctgatgagaaatccatcatcaccggaattgtttttcctttctaggtaaggtgtcacctttctctgttgttttccggatattttccttgtctttcttttccaacattttattttgtcacgtgtcttgccatagacctctttgggttttatcctatttagggttctcacagcttattgagcctgtaggtttatgtcttttgccaactctgggaagctttcggccatttacttctttgagtatgttttcagccttgtcttcttcctcttccccttccagacactgataacaacatgaaagtgagaacttttgaggtagtttcacaggtccctgaggttctgttcactttcccccccagtctattttctccctgttaggattctgtaatttctgtttttctcatctgcagtatatgaatttgtttgctccacaccatccattctgctgctgagcctatctgctggactttttattttagttgcatttttcacttctaatacttccatttggttcttatttatgtcttgtatttatttgctgagtctttctacttgtccatttgtttcaagtgttcttataagtactcattaaatcatttcattaggcttgcctgctttaaactctttgtcagacaatcccaacacctctctcatctcattgccagcgtgtatttgctgtctattttcattcagtatgagattttcctagttcttggtatgatgaatgattttcaattgaaacttggacttttgggtgttatgttatcagagtttcgattttattgaaaccttctgttttaactacctttttttgagtctgtttctgcaggggaagaagagtggtgccatctcattgtagccaggtgtgtgtaaaaatccaggtttctcatctgactgacctctgttgacaccctgagtggaggagctgctaaggtaggagagggagttccagcagcccactcctcctccactgctacatccctggctgggtgggtaggagtgcttcattactgctttccacgtggcctccagtgacaccacaggacaagggcagccttattactgctgggtggatgaaagtcctgactctccaccaggactcctctgataccagcctagcagacagagggagaggtgcctcatgaccatctaatgaagtctaggctccaaatgtagtttctattgacagggaggtaaacatattatcacctggcagggatgatgatgacagccccagcttcctcctctaacatctgtcattgaaattgtttttcccctctaggtaagatgtcgtctttctctgttgcttttgaggtattttctctgtctttagtttccagcattttagtcattgtgtgtctcatgataaataaaatgctggaacctaaagaacccccggggcaaggtgggggtttagcatatgtcattatacctgcgcaagtgtgaaacccgaagcccctcactgggattttgctagcttttatgttgatgcagccacagcttttcttccacggtgcttgacctgaggaaactgatgatcgtatatgtgtcttgtcttgctagactgcccctttgctgatcctttgcctagagagagcaagattgtattggggtttgctggatctgtagccattggtatttctgggttgccatctcctttggctctacatctaggatgtatgcgggggcatggaggaatcctgggaactcatctcctggctttctgtgggtcttgaggaagccagatggcctcctaccttctctttgcccttcagtcttcctatgtttgttgtatgtacaatgcccaaggtttttagatgtaatgagcaggaagaatagggcaaagttcatctattccaccttcccagtgtatgcctgtgatttccctgtcttgccttattgatttgggtaggattgtcatgtgaaatatcagtggtgagcgtggtcttccttgcttagttcccagtcctagagggaaagcatgtggtctttcaccatgaggtaagaagttaactgtgaatttttttgtaagttgtctttatcgagctgacaaagtcctgtgttcctatgtttctgatagttgtaaaacattctctttcttcccttctttctattttttcttatttctgttgtttgttttgtttttttgagatggagcctcgctttgtcacccaggttggagtgcagtggcgtgatttcggttcactgcaaattccacctcccaggtccaagcaattctctgcttcagcctcctcgtagctgggattaacaggcacctgccaccatgcccagctaatttttgtatttttagtagagatggggttttgccatgttgactaggctggtctcgaactgttgacctcaggtgatccacccaccttggcctcccaaagttctgggattacaggcatgagccaaagagcctggcctcccttctttatttctatcatgaatagatgttgaatttgtcaaatgatttttcttcattgactgataaacatttttgtggtctggttttggagttggggtaatcatagctttacagaaatagtcgagaggtgttccttcatcttctattttctggaacagattgtacagaattgatgttaattcggctgggcgcggtggctcacgcctgtaatcccaacactttgggaggccaaggcgggcggatcacgaagtcaggggatcgagaccatcctgactaacacggtgaaaacccgtctctaccaaaaatacaaaaaatcagccaggcgtggtggtgggcacctgtagtcccagttactcgggaggctgaggcaggggaatggcatgaacccggagggcggagcttgcagtgagccaaggttgcaccactgcactccagcctgggagacagagcaagactctgcctcaaaaaaaaaaaaaaaaaagaattgatgttaatttttcttcaaccgtttggtagaattctccagtgaaaccatctggacctggagcttttctttctggaaattttaaaattaggaatccaattattttcatagttacagagctactcagatgacctgttttgctttaggtaagttgtggtagttgatacttatgacaaatttgtccaattcatctgggttgtcaaatatatgtgtgtacagaattttaaatagtttttcccttattattatccctttgatatctgcagtctgtaatgagtgtagtccctctttcatcctgatgttcataagctgacttctttttttctttgtcaagtttattgatcttttcaaagagacagctttattttcactagtttccccttttgtttttttctgttttcaatgccattgatttccgctattatctgtattatttccttccatttgctttaggttttttttttttgtagattcagtctcattcccatggcgcaggccggagtgcagtggtgcgatctcagctcactgcaacctccacctcccgggttcaagcgattctccttcctcagcctccagaatagctgggattacaggcgggtgctaccatgcccagctgatttttttgtatttttagtagagacggggttttgccttgttggccaggctcgtttcaaactcctcacctcaggtgatccacccaccttggcctcccaaagtgctcgtattaccggcgtgagccaccgtgcctggcctgctttaggtttcttttacttgcttttttcttgtttcttgaggggggagcttaagtgtattcatttgagacatcccctcttttcttttatcccttttaaaaacttttgtatataattattattgtaggaagttaggcttgggcccgcaaactatggaagaacagaatatactaggccgctgctttaatagctggtgcctgcttgtcgcccacccccactcccccaccttagctgccttgtccaaaccaaagagtttagtctagaatggacatttactagcctgcaaaatagttcactacatctattcttatcagcttgcctgactgcccaggtcataagtcaaatacttgaaaagcccccgagctgaccatgattgcaatgcattatggactgcaacaaaatacagggagacaaccctaaaaaaaaaaaaaaaacaacctaaaagtccaaacccaagatccaataggcgacatccgggaatactgtgaccccatagtactcagcctatgaggaaccgggggaggcacttccacactaggggataaattgcttgttgtaagcctactgggtgtgcctgcctaccagacacccgatcttgcaagactgtcattaataataagtcgcacttctgctgttttccgggtcttggagtccattctttgggtttggacaggtgagtttatttctcacgattatttccaggcaggccttgcccagtgggtggctcatgcttgtaatcccagcactttgagagggtaagcctggtggatcacctgaggtcacgagttcgagaccagcctggctaacatggtgaagccccgtctctactaaaaatacaaaaattagccgagcgtggtggcgagggcctgtggtcccagctactcaggaggctgagacaggagaatcacttgaacccaagaggcggaggttgcagtgagccgagattgcatcactgcatgcgacagtgcaagactccgtttcaaataataataataataataacaataataataatggcacgacctaaagttatgcaagcatttgccttagataaaatttcaagttttcaaagttgttagctgggtgggcggcatggctttacttcctatttcttggtatgtcctaatcttgttgaaaaagtttttctttttctcaaaggcttatttcagtggaagcccatctgcaaaatctgttattaatttaaattagaaaatcactacaagtcccactgacatgtgggttattgtttttgcgagtgacctaaggccacctctcgggggagctgggggttgccttcccacgtctgcgcgtctgcaccccatgcccgggcctggaagtcagactcgggggcggtgctgcagcaccaggcctgcagtcctaagcgcggggtcgctccgggcccccgagggggtgtgtcttctgcccctttaacctggcaggggcggttcaagtggccctggaaatcagcgatttgtagggtcaagggctggtgctttaaaagagaggcggaggggagagagggatttcccggtctctgctgcactctgtctatccgctcggttactccttttcctggcccgcgcgaacccgctgtgccgcagaggcggccatgtacctttaaggccccgctgcgcctgcgccttgggctctcctgacgcgccgggcgggaccctgaggagccagctggcgcaggctatgggctgggcggcggttgagacagcggcggtatcgggaggggtaggtgagggtcgcgaggctgcgtgagcatctgagtgaacgcggtgcttttgggaacgcgggacgggcgacctgtggcgccaggagcgggccgaggcgtggcgcacggatgccgtctggatgggaagttacggtttacagcgaagtccacccagcgtttccgaggtgaaggcgccgcgccaggccgggcgggcggtgagtccgggacccgcgggtacacagctgggtcgagctgcggctgtcgcaagttttgttgcgagcgacggagggcgaggcggggtggggggttgggagggcgtgtgttccggccccgccggggcttaagttccatgcgttggattcctcgcttgccgctgccgcccgcagccctccttgggcgctggggaagaaactcgctggcgggtgttctgtggcatctcagggggtggagggacgagcagcttcgggggcacgtcctcgtgtatcctgtggaggaccctgaccccgcaccccaccctcgaggccagaaatcggttgcctctggggacctgagaagcgagaccactcgcgcccctgacttgcaaagttggggtctttattggcctccgggattctgctcctggcggtttctccaggctggtgatgggcaagccgggtgtaccaagtccaggatgcacatgaggagcgtttgtagcagtcactgaatcacctcatgactagcggggcaggcctctaattcaccgcaggatttccggtaggttggattgtggggttggtgtttgcactccaaagagttgctgtgatttccctgtatctgtctttctggcttgttagatcttctcatttggcgtcctttctccgaagagttaaccaagacgtttggcatggtttccttgctttcctcctatcttttgctgctagagctgctttcgaaaagaagtcttttcttgcagtggtatcttttctttgggttacagtgttgttcatcctttctttgccgaaagaatgaatcccagtgcttcacaaggttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaaaaaaaaaagtacaggtaatgaatttttaccaagtgaaccaccacagatcaagaaatagaacattactagactggggtatatttgtaggagtggcattgttggttttagaggtatatgaatgataaaacttagtattacatattgttgaacgttttcccaaagtggttgtaccatttagcagggatactctggttaccccacatccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttctggttatgtgtcctttctacgatatatatgtattgcatttcccttttttcaatctgtagcttgccttttcgctcttttaatggtgcttattcatgaatggagattctctaactttttttttctttttgagacaagatctcactctgttgcccaggctggagtgcagtggcacaatcacagctgaccgcaaccttgacctcccaaggctcaggtgatcctcctgcctcagcccccaagtagctgggacctacaggtgagcaccaccacactcagctcttttctgtatttttagtagagatggggttttgccacattgcataggctggtctggaattcctggtctcaggtgagacatctgcctcggcctcccaaagtgttgggattacaggcatgagccactgcacccagcctgagattcttaattttaatgaaattatactttatcaatcttttcctttatggttagtgctttttgtgtcctgtttaagaaatcaatgccgaacctaggagtatgaacacatttttctgtgttaaccttatagcaattttattttagtttttgcatttctttttttttttcagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagattgggattcaacatgtttcccaggttggtctcaaactcttgggctcaagtaatcttcccacttcaacctcccagagtgtggggattacaggcatgagccaccccacccggctatgattcactttttactacatggatgtgtctgcttgatccagcaccatttattgaaaagactatccttttccttctgcactgtttggcactttttttcttaaatcggatgactgcatggtcatccaatttatgaaattagtgtgggtctgtttctgtttctggaccaacctgggcaatatagtgagatcccatctctacaaaaaataaaaataataaataaatgagtaaaatttaaaaaataagtgcatagagcagatggagtcataggtgataatttataaatgattgtcagtttcttggctacatacgggtgttggtaattcagatgtgttgggcattcagggaaaatgtattaagggaagtatgtggtgttcacagtgattgctagatgttcattgtgacttgaattagatgttatttgagcctcacagagctacagtcttgactctttatttatttatcttttttacaatttttacaatcttcctgtcaaggcagtaactcttttatacttcattgttcttaggtatacttaattaccaggaaaactttatggatcgtacctaaataagcgttaagccatttaaagggccgacgtgatgtgatgtaaacaatagtattctacataatagttttaggactacatcgaacaattttttttttttttcttgagacagtgtctcgctctgttgcccaggctggagtggagtggtatgatcatgggtctctgcagccttgacctctcaggctcaagcagtctgcccacctcagcttccttagtagctgggtctacaggcatgcaccactatgcccggctaattttctattttttgtagacagggttttcctgtagtgctcagactggtttcaaactcctgggctcaaatgatcctcccaccttggcatctcaaagtgttgggattacaggcataagccatcaccgctggccattttagttttaataatttttatgtttttctaatttaaaagatttactaaaatctcttacagctattatttatgagtatagtattcattgttgttattatgattattttgtatgtgttcaatctcattttcaacataagctcctggaaatttgagattttgtctcttattcaccactgtattctcagtacttgaccttgcctggcatgaaacagatattgaataaatatttgttaaaggaatgaatgaaggaacatactaataccatattcaacaatctccaagtgtcacagttttcaccatctaacaaataaaatagcttgtatacagcagagtcacagtcaacctgacataaaaggaaatgtcaatgaaaaataaacctttgtatgtgttgctgctaagattttggggcttttgttactgtagcataacctagcgaaagctcagcgagacagcctgtagaatatacgtgtacagatagaccagatagaccagtagatgagattccaaagaagcattaactacacccacacactcataattccctaacagaaagaatcgaattcttgttcactaagatctgcctcaagtattactttgtgaaaacttccctggctactcaagtatttagtcaggactctttatttttttttcccccaggctggagttcagtggtgccatcatagctcactaacctctaattcaaggctcaaggaatcctcctgcctcagccttctgagtagctgagactacaagtgtgtgccaccatgctgggccaatttttcattttttattttcagagatggggtcttactatgttgccgaggctggtgaggactgttgattacatatgacaggaacccaaacaattctagttccccaccacctttcaacctgctcctccctgggtcttcccagtctccgtaaacggcagctccatccttcaagttgccgaagccccaaatctcaatattaaccatgatttctctcttttatctcataggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctggggctgccaccaactcccactgtccagggcttccagtggactctccgaggtactgatgtagaaacttccccattcggtgcaccaagagcaacctcacacggtgtgggctgaatgaagagctgccagatcccacaggtaaaaaccctgaggcattgccagctcgatggagtcagagagtcctttttctattatgactcagatgtgaagggaagatgccaagggccctaaacatcgcagggccttgcctggcatgaaacagatactgaattaatatttgttaggtgaatgaacaaatattcacagcgtgtgccaccctcgacctgcagtgccgtcgtcaggtggaagtgattttacctcaggagaggagagtgttctctccaggacttttccttagtagctagatctgcatcccactccttgctcttcccctcttaccccccattctctgcccccatttccgtctcttgtttccaccctgccgtcccctttcacctgctttctcctcttcagctttcatggctcaccccctccctgtccacccgcatcccccaggctaaggccctgcactgtcctgggtggggagatgtgtgtggttttaggcagtgccctctagatgtgtccaggatggggaaacatggctcagttgccagtataatgtgttaaaagagaggccacttttgaaggccgttcccatctcccattccagaatcctgtaggacttagaatttatgggccacagtggaattcttggttccccaggaccttgtggtggatgccttctttcactgagcattcatggggtgactattaggtaccatgccctgctctgggctagagaccccataacgagtaaatctcaggtcactaccccatggaacccaccactgcaggcattgagagggggagaaagaaaggggcatggcctgtttgtatccttctcacgtggccgtccaccaggtcctgggggagtgggagccagtgcaaggagggaagtccagtgagaatgacaaatggacgatgtcagacccaggggctgaggcccccacctgcagctgggaagcttctggagtggacaaggagcagcagggaaggttgcggcctggtgttctgggatccactgtctcatctcattcttttgggcaccagaacttatccaaagacaagactcagtgtctctggcaacagtgggccagaggaataatgtgtttcagaggaggaagaaggggttgtaccccgtggaaacagcatatagttttacagtagtgcatctgtctccaataactagttagcgtgttcctgttaatgggaaatactggtggtgtaagttcccctggatgttctcatcttcatgtaaatttgttcatttccttccttccttccttccttccctacttctctcccttccctacttctctcccactctttttctctctctctttattctttccctccctccttcccttctgccttccctcccttcctttcttcctcccttcctctctccctccctgccttcctccctccctccttttcttcctccctcccttcctccctcccttccttccttccttccttccttcctccttccttccctccctccattctttcctttcttcctttcttcttttctttttctttgtctctcatgctctctctttttctttcctttttgttctactttttaaaaaagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctagctgtgttccgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaaaaagtaatagatgttattttttagaacagttctaggtttacagaaaaatggagtggatagtacagagagttctcctaggctcccctgtcctccagcacacagtttcccctattagtatgttgtattagtgtggtccattcgttacaattgatgaaccactattgatacatcattatcaactaaagtccatagtttacactagagttcattctttgagtttcacagattatgggttttggcaattatgtaatgtcctaaatccccaatacagcatcatgcaaaatagtttcactgctgaaaattccctgtacttcaccatttcgtgcctcctcctctcctccacccctgacaaccactcatcgttttactacttctatctttttgactttccaagaatgtcctagagttggaattacagtatgtaggtttccagactggcttctttctagcattatgtactttaagttcctccacgtcttttcatgacttgacagcttgttttgtaaaatcactgaatcagatttcattgtatggctacaacacagtttgtttattcattcacttggtgaaagacgtcttgggtacttccaagttttgacaattatgataaaattgctgcaagtacttatgtgcaggattttgaatgaacttaagttgtccaaagtgactgtacacttttgatttccactagctatggagagttctggttgttcctcatctttgacagcatttggtgtgttcaccgttttgtgttttagccattctgataggtttacagtgatatctcgttgttttaatgtgcaattccctcacaacaaatgattttgagcatctttctcatatgcttatttgccatctgtatatcttattaatgaggtgttcagatgtttcacctttttttttttttttttttttttgctttgtgttgtttagttctcagaattcttcatatattttggacagcagtttttccatcagattattttgtaaatattttctaccagtctgtgacttgctttttccattctcttaacagtgtctttcacagaacagaagtttttaattttaatgaggctcaacttaatttttttttcattagtagattgtgcttttggttttgtatctaagaagccatcattgaacccaggatccctcagattttctcctatgttatctcctaggattcttatggttttgcaccttacatttacgtgtaagatttattttataaagggtataacatgcatacctggatttatttatttttttgcatgtggttgtccagctgttctagcaccactagttggaaaggctatctttgctgttttaaattgtctctaaacctccatggaagatcagtggactgtatgtaggcctgcttctgggctccgtattcttttccatgcatctatatgtgtgtgttttctcttttcaccaacttcacactatttgggttactgtagcttaatgtaagtcctgaagttggtagtgccaaacctcagggagtttttctgaacttcatcatgagaacctggttgagatcattgtagtaacacttggaaatgtgtgagattcccccttagtctggtcttcaaggagtttttaatgttctagccaggctaccctcagcttctagtaatctgtcagtaccatttaagtgctcctcccacttgctgtccccagtagcttctcttccctgtgagctgtgactccttgtgtgttagcctgtgtttctcatttttaaggtggcagttttccctgtgacctcaattctctgatccaccctagaagggttgactttcagtttgttcagcttttttctagctgtgaggacaagtgatgactgcctagctctttccatgttgaaatagaaacccaaaagtttgtttaaagaattacttgttataaaagtcccccattgttaatgtacaactcaatgatgtaagttgatttatcgaattgtgcagccatcagcagagttctacttcagcatattttgtcacttcccaaattcccttgaacctgtttgtagtcatttcctaatccctggtccccatgactgggtctgaatagaataaatatttggaaagcagacttcattatatttatattttcctgtgtttgggactttatatagtggactattgtgttcgttttgtgacaagtagagaagagattgcattctagggatggtttttgggggaacataatagtagtcctgtttatggctctccttgaattggttcatctgtgctggtgactggtattttttaccaaaccttgtctggtgagcacaagaaaaagaatttttaaaaatctactattaaaattgagatgatacattttcacataataatatttgaagtagtgaaccgtctttattttattttatctttttttttggagatggagttatttctcttttccttgggctcgaatgcaacggcgccatctcagctcactgcaacctccacctcctgagttcaagtgattctcctgcctcagcctcctgaatagctgggattacaggcgcctgctaccacacctggctaatgtttgtatttttggtagagacagggattcttcatgttggccaggttggtctctaactcttgacctcaagtgatccacctgccttggcctctcaaagtgctaggattacagacatgagccacggcctgacctgaactgtggggaaaagaaagagatatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtgcccagagacacactacactgcggaagactgcagggacctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatatcccatctactgagataggagaaaactgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgctggcatgggtcctccatatgctgaacgccggtcccctgggcccatttttctttctctgtactttgtctctgtgtctctttcttttccaagtctctccttccacctaacgagaaacgcccacaggtgtggaggggcaacccatcccttcactgaaccatttttattctttcagaaatgtgattgataacagtaaagccacactactcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgttttattcctagagctcaagctatttttccaggttcactacagataatgaaagagttcctattcttgtttgtggggggctgagggccctttttctgtgctggctgtcagcggggagacactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatccagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataacaactacagtgattctagttcaaaatgagggaacatggaggggataaagaagtcactaacccaaaatagtttggaaatggagctgggcaaaatccagcaggagtttcttagttaggatccacagcctgggactgaccctctgtcctgtgggtctttacctctgggctctctgctctgcatttcttgaaaccattattatttatcattttcctcacactcttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaataggtagatgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttggtaagatttactggttgggaatccaaagttaatgccaagaagcagccgccagttgggatcaaatgtgagcctatggatcaaggtgcgtactcaaacacagagagctttgtgaaagatgctaccagtagtttttccagggcagagatgggtcctttatttttctctctaatctagcccatatgcttagctgagttttcttcgtatcactttaaatgatgatgtcccttgttcaacaattttctaaacattctttagataataattttatgggcattctttattgcattaggcttaaatttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatagtcatagaattggttcagtggttgtgagtgcagcaacccaagagtgtcttatctgaaataccaccaggaatgtctggacacagtagacaaaggtttttcaactggacgccttaggatacatgcttccaaaaacaaagtagccaaaaagaaaccagagtcacagaatatcagagccagaggaacatttggaggtaattcagtacctcctccttttcaacctacaggggagatagtggaagagaagcagggatgggtctgccttctgtgcccacaattcattggagattgttgtggtgaagaatttcttttatgataaaggagaaataaactcccatcagctttaattcaggcaggtttattgaaaaggtgaagaagcgtcttgcagaagcaaagcatggctaaggcttgtgggctctgtctggacaaatgagcagccgacagtggctgatgctgcccctgactctggagccgtgcggtctgtggttctctgtgagcatctcttctattctcttgcaccttccctcagcctggcagtctctgtgtactcttcaacccataattgagcgaggctgtaccagccccaatgccatgtagcactttatttcaaattagaaaggcatgaaataaactagccctttataatacaactgttggaacaacagttgaaaataacaatatcttgactcctggttgagtgctttacgctgagctttcttttctgaatatgagcacagacttggggatattagtgtcacctggcattattagctagtattctccttttgtttccccataacatcccctcctccttcccacagatccactctccactcatttccatcctgtcttatgccacttggggcttgtcccttctagaatgcatccctggctcccctgtgtgcacacttgtagttaggtttagcattgggggcacccgatggagcctggaagtgagaggaaggtgaggtccgtatttcttccctctccctccctgctctggcactgagtatctggcaatagctgcatctgtctattacttcagtggccactcttccacagccccaattctcagtgggtcccatagcattatttacctttgttcctttagctcccatcaaggaagacccagaggcattctcctcaccaaggcattaagaaatgcatgggtgaggggaacagcggcgtgcgtgtaaaggtcctgtggcacctctcctctgcaggctggaggtcatggcgggagatgctgcatggatttgtcctccctgctgtcagaacaacagggttctggaagagtagaggacaggccgtgggacttggctgtctagagacaaggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttatatattatcagggcaaaagagaaaaaccgtatgattaccttgtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagagaaaaaagtagaatacctgttgttactcttttaattcagcattatactagagctctaaatcaatgcaataaagtaagaaaaattaataaagtattgaaaagaaagaattgaagctgtctttattcacagataatgactgtgtttgttaacaatgctagaaatctacaaaaatctaccagaactaatcagtgagtttagtagtgttgcagaatgtaagctctcaatataagtggtcttttgtatttctgtatattagcaatgagcatttggaaaatgaaataagaatacaatttcatttaaagtaacatctaaatacatgttgtgcttataaataaattcaacagactgggcaccgtggctcacacctgtaatctcagcactttgggaggccgaggtgggcagatcatgaggtcaggagatggagaccatcatgcctaacagtgaaaccccatctctactaaaaatacaaaaaattagctaggcgtggtggcatgtgcctgtagtccagctacttgggaggctgaggcaggaggatcacttgaacctgggaggcagaggttgcagtgagccgagatcgcatcactgcactccagcctgggtaacagagcaagactctgtttcaaaaaaaaaaaaaaaaaaaaaggaaagtcaacaaaatttatgtaaggccagtacaccaaaaactacaaaaaattgctttgagaaattatgaaagaactaaattagtggggagataaaccttgtcatggatcagaagagttgttatgtttaaaaagtcagttcttcgtaaattgatctccagatccaatgcaattctaataattccaagcggcattttggtagaaatttacaagctgattctaccatttatatggtaatgtcaatgatcaagaataataaaatagcaatattataaaagaataatggcgaatgaattcactacctatttccagaattactctacagctatgaaaatcaagattatgtgttttgttgaaaaaaaaaatggaatatatatcagtggaagagagaatccagaaatagatactcacatgtatgtctaattgattcttaggacatatatatatgtatacacacacacacacaaacgtgtgtgtgtgtgtgtgtgtgtgtgtgtgtatatatatatatatatatatattcaccgttttgaagattatcatctccaaatagggaatatatatatatatatatatatatatatatatacatatacagacacacacaaacacacacacacacatacatattgcagtctgataagataaacagcacattgaaacaatttctcaaaagacttgaatagatacttcagaaaagaagatacatgaatggtcagttagcataggaaaagatgctccactgtttagtcatcagggagatcaatcagtgcaacaatgagataccagtacatatccataagaatggctaaaattaaaaaggctgaaaatagcacctgttggtgaggatataaagcacttggaagtcttatacttgtaggaatgaaaaatggtatggctcctttgaaaatctaacagtttcttaaaggttaaacataacacaaatcagatagacagtcattcccttcctaggaatttacacactgtgtctgcacaatgatctgtatgtgtgtttccagaccaacctgaggggcgggctgctatttctcgtggctcagtaacaagacacagatgaactggggaggaagagagttttgacttctgcaactggttacagggaaacggcctggaaattatcaccagaccaactcaaaattggaaagttttcctgagctaatgtaccttctaagctatatgtgtatgtggaagtgtgcattcatctaaatacataagtgattaacttcttttaatctataactaagtctgagtcctgaagaccttcctctggaacctcagttaaattcagttaatctaaatgggtctaggtgctgggggcccttatcttgtctcctgctaaatcacagaggtttggagagtcccttcagatctccaataaacttgtttgtggaggcctggggagtttcttcagacccccagtaaaacttatttaatactaaatggctcctgttaagaatgccttcgttatttcgtcatgctttaaggcccaggaaaaacctaggcaaaactcttggtgggcttttgttacattccagcctttgtataagggcactggcttctttttttttttttcctcttaatatttaattgaaccactcagtcggtactgaaacagttgttacggaggcctgtgttagtgagacctggcctgccacgtatggatgctcatgatagtttcttcataatagcccaaacgcggaatgatagaaatgtccaataacaagtgaaagtacaaacatacatggtatagccacacgaaggaatactactcagtatttacaagacattacagatggattttaaaattacattgatgcatgaaagaaggcaacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaatagccagaatcattacatgcttaacaatacatgcaatgaagcaggtacaaggcccctaaaagcaattggtgagaaaaattaaagaaggctaaataaatatatatcatgttcattgattggaagactcaattttgttagcatattacatcaacacaattctgattaatatttctagtaggagattttagagaaatttgaaagctagtttcaaaatgtatttgaaaatcaaagaacctagaataagcaagtcggtcttgaagaagcaataagttggaggacttactctgctagatttcaaacctgattttaaagctacagtaattttaaaacagtagtaatggtgtaagtattcataaatatatcaaagtaaaagaatacagattcaaacaatatgcccacatatgtacagttattgatttttttttagtagaatcttttttattcataaaaaatccatcaaaacaaaaaagttttccagccacacacaggaggggtatgggtgggggaaggtgtctgtccatctatccctggcccccagcccatgtggttttggcagcaataaggtgtgtggggtaatgacccctgaaattaaaatggtgtgtgtatgtgaaggaaaggcgggcaaagctatggggagcggtggagtggaaggaacaaaggaggtcagtactgggaacgctgaaggtgggaggccatttcataacattacttgttgatgaaattgccatgaataccttctttgcccatcagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaaggtgggtccttgttgccaacaatggccgtgtcctaacaggtcccgtccgccacgaggctgtagatggaggtgtccacctggccgttgcgttgctgcaggggctcctctggtcgctgctgttggggccgcctgggctggcgggtgggggaggcggagagctcgatgcaggtgctgtcctcctcgccacgactctgctagctgtgcagtagccctcgctccgccacttaaaaaagaaaaaaatatatatatataatatatatacacacgtgttatatatattgtataatatatatacatgtatacatgtatatatgtgtatatatatatacatggcacacgtgtatatatatataatatatacacgtgtatatatatatataatatatacacgtgtatatatattaataatggcctacatctatattaataatatatattattaatatatatattatatatattaataatatatatacacgtgtatatatattatatatatatatatacacgtgtatatatattatatatatatatacacgtgtatatatattatatatatatatacacgtgtgccatgtttgtttgctgcacccattaactcgtcacttacattaggtatatatcctaatgctatccctcccccagccctcaccccatgacaggccctggtgtgtgatgttccccgccctgtgtccaagtgttctcattgttcagttcccacccatgagtgagaacatgctcgcaccgccgcttctaaatgttttaaaaacaaagacaccaatgcccttcattggggaaatgaaagacttttaagtaaaacaattttgagtgaaataatatttgttgttttaaaaagttaatattaaccactctccatcatatattgaaattaacttaagatgtgaaagttaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactgaaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggtgcggtggctcatgcctgtaatcccagcactttgggaggccgaggcggcagatcacgaggtcaggagatcgagaccatcctggctaacacagtgaaaccccgtctctactaaaaatacaaaaaaaaaaagaaaaagaaaaattagccgggcgtggtggcgggcgcctgtattcccaactacttgggagtctgaggcaggagaatagcgtgaacctgggaggcagagcttgcagtgagcctagatcgcgtcactgcactccagcctgggcgacagagtgagactctgtctcaaacaaaaaaaaaaaaaaaaaaagtcaaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttattgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaagttaagaatttcagttacttacatccctcagtcctgattaaacctatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcaggtgggggtgggactagagttaaactgccatttattgatttctgacacaggcacagaatgacctgttttctccaagaggctcaatcatgttttcaagaatcctctctgtaccatataagatcctgcagacaaataacatctagtctgttgttctaaatgtctgagactagtgaacttttcttcagttcaagtttctgtggaggcccaacaggcaaagctctgttctagtgactctgagggaaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgcctaggaggctgaggcaggagaatcctttgaacccaggaggctgaggttgcagtgagccaagattttgccattgcactccagcctgggcgacagggcaagactgttaaaaaaaaataataataataatgataaataaaaataagaataaaaagcagagagtagcttggtgagagtgaagtcctgcttcctggggcacagagtcttgttgctaaagaggaagaaagatcgcatccgagaatgtgtggagatagcagtgcagtgtacagagcagggactgtgggcctgtctactgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtaaacactatctattagttgttcattctgctgtttctaaattaacacaaactttattagcatttgggcatatttccttcatggccttatggtgttatgtgtcactctttatgcttcagatatgattcttaaaatcataactgaagatatgatttaaaaatcaaagattttaaaaatctttcacatacttgtccttgaaattcccagtaaaagggaaaccatcagtcccatagtcctaggggccttcccgactgtacgagaaatcactacttcatgccccagtgcagtgttttagaggagaggctgcaaggcttgggaaagtggccccgcattcagagtcagacctcagggactgtgaattctgactccactttgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggcgtgtctgtcttttctcagaatatgaagagtgcaaagatctcataaaatttatgctgaggaatgagcgacagttcaaggaggagaagcttgcagagcagctcaagcaagctgaggagctcaggtgaggggaccccatgggggcaggcaggggggcaggtgtgtaaatctctgaagtacagcagctcggtggggagatgtaagagctaagctgggccaggggaagggcaggaattgccatggcaggctcgctacacacaaatatttatcaaacagagaagaaggataataaaaatgtatgggttgcagttgtttctcagagccttgttttctctttttcaagcaagtaattgttgatgtgaaatttacataacacaaaattaaccaaaggagtgtgaaccacacagcagcattcagtatactcaaaatggtgtgccatcaccaccccacttacccttagtgagaatcacctcctgactgactgcggcttctcattctttcactcaatcaatgttgccttctcgaccctgtcattcttttcttctttcgtcttttcaattcaccccatctgcacctggcctcatttctgtacatggctttgtatctagtggccgcaagatgcactatgtgtattttcacatggaaatgtccatggccagaggaactgaaaggatgtctttttgaaacggaattaggaagacacctacttttgtttacagaagagaaagatgaatggaacatcatcgaggatcttgcaggagccctctctgatacagaggaagcctgtaaaccattttctattctttctcttggccacagacattcctttaaacatgtgctgaccttctgcttcgaggtctccttgaggacattgtctcagaaatctctgttgcaatatttgagcggatcactcaaccctttccactcttaaattttctctaccgtctcaccttaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagaacggagatgggaaacccatggggttggaggtcacagtattgcaagtgtccctcctcccttgatggaaggtggtctttggagtatgaggcagcatctgtctagttttaaaggacaggaaggaggctgcgatgggagcaggcttgttagagtgaaaagagctctggactaagaatgaagattcccaggctgtcttttcggcaatgttcttagtaactgtcagagagtgaatgacttgtccttcctgagtttctctctctccgtggcagacaaattgtctcttgcaagggtctgaagcattcaaatgtgggaacacttacaactgctttccaaaatgagatgaaggccctcaccgtgtgatgttggagaaggcactttatgtgggggcgttttgtggtaggaagtgcttcagactggagcactccccatggatagaatgtccctgaataacacagcagaagccacttggaggcttgaaatcttctgatgcatagaggactgtgggacaagtttgtctgcttctaagagaaagaattaggtttgaaatgcaaactgtgacgggacaccaagcctgtgcctgggaatcagatctggcaggatgggggagacagctgccaatgtccagagagaggctgcacaagcctccagtgatatgggaagcaaaaggtcttttcaatatttggccacatcttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaatataacccagcttagacacagggtgcggcagctgtcatgtttctctgtgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaacaggattgcatgttccctcttaatgggaacgtccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccaggtagcctctgttttccttgtgtctcatacctctctctaggctgaggaagataaactctgaagacaggctctatcaacacaaattcatttgaataaaaaactgtgatgggtttctaaacagatatcagggagtttttttgtccttctcagctaatgtcatgcctttgtctgccagtccccagtatcaagttactcaaccccaggcaagtgtgacaatctcatagtcacctgagtgcaggaggtgcacaggccatatctgtcaggcctcctagcttcgattcagtatctcttgtcatctgtgattaagtcatctgtccctgaacaatgcccatggagtttctatgcctgtttaaggaagctggcagccttgcctttgtatttggaaatatcgttcctcaggcttcactgctctcagctttcatctggatctcctttaagtcagcttgcttagctgcacagtcaccctgaaatcaggacggaaacttttcttctttactttgctgatatatttccataaagcaaggctggaccctggttctccaccctgtcaatgcaatggctgatccaatgtttctttgtagcatcgtggattttttttttttttttttttttgcgatggagtcttgctctgtcacccaggctggagtgcagtggcaccatcttggcttggtgcaacctctccctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtattgcagcaacactcttagaaaattgtttgaccaatttttggagatttttttggggaaaaaattttgtttaactttgactcaggcagggaatatgtcattatggtctacacgtagagggagattttggcctgtgggtctggaaagcagggtcatctaattctcaccaaagttaatctaggacaccctagaatattcctgtcagaatccttattcttgcactgagaatagttatgtccttgtgctatgactggacagtgatttgttcctatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgtgtctctatctcctttagttctgctctgatcttagttacttcttgtcttctgctagcttttgaatttgtttgctttgcttctctcgttattttaattgtgatgttaggatgtcaattttagatcttttctgctttctcttgtgggcatttagtgctataattttccctctacacattgctttaaatgtgtctcagagattctggtatgttgtgtctttgttctcattggtttcaaagaacatctttatttctgccttcattttgttattttcccagtagtcattcaggagcaggttgttgagtttccatgtagttgtgcggttttgagtgagtttcttaatcctgggttctaatttgatggcactgtggtctgacagtttgttgtgatttccattcttttacatttgctgacgagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccattatgattgtgtggagtctaaatctctttgtaggtctctcaggacttgctttatgaatctgggtgctcctgtatagggtgcatatatatttaggatagttaactcttgttgaattgatccctttaccattatgtagtggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgagtacagcacactgatgggtcttgactctttatccaatttgccattctgtgttttttaactggggcatttagcccatttacatttaaggttaatattgttatgtgtgaatttgatcctgtcattatgatattagctggttatttcgcccgttagttgatgcagtttcttcctagcgtcaatggtctttacagtttggcatgtttttgtagtggctggtaccggttgttcctttccatgtttagtgcttactttaggagctcttgtaaggcaggcctggtggtgacaaaatctctcagcatttgcttctctgtaaaggatttatttctccttcacttatgaagctttgtttggctggatatgaaattctgggttgaaaattcttttctttaagaaggttgaagatgctggagaggatgtggagaaataggaacacttttacactgttggtgggactgtaaactagttcaatgattgtggaaggcagtgtggcaattcctcagggatctagaactagaaatactatttgacccagccatcccattactgggtgtgtacccaaatgattataaatcatgctgctgtaaagacacatgcacacatatgtttattgtggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtggggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaatatatatatctgtatatatatatatatacatacacacaaaaaataataaaggaaaactatacatatggaaaaaaaaaagaatgttgaatattgctcccactctcttctggcttgtagggtttgtgccaagagatctgctactagtctgatgggcttccctttgtgggtaatccgacctttctctctggctgcccttagcattttttccttcatttcaaccttggtgaatctgacaattaagtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcattaatttgatcttgaatcactgataccatttcttgcacttgatcgaattggctactgaagcttgtgcatgcaccacgtagttctcgtgccatggttttcagctccatcaggtcatttaaggtcttctctacactgttcattctggttagccattcgtctaatcttttttcaaggtttttagcttccttgagatgagttcgcacatcctcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggtgacctacagatggggttttggggtggatgtcttttttgttgatgttgatgctattcctttctgtgtgttagttttccttctaacagtcaggtccctcagcttcaggtctgttggagtttgctggaagtccactccagaccctcaaacagggatttcttggtgttgcctattctctcccatgtgtttaaatccagggagaggtgtatacatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctgtgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcaccgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgcagcacatgcccaggagctgtctgtcagctcagctcatctgaattaaatgtctcttgccagctacaaaattccttatgagttttgttcccaaagcatgtctgtgtggttctttacctgcccaaggccagtgtcacccttgtctacttctcagtgaaagatgtgacccaggtttcactgaatttattcccattttctgtgtcttctaagtgcgcttgttttagctcatctgtccatcatgttcctggtacgttttctagataaacggctgacttttcacccacaaaagccataatagctgatgcttctgtgtagaaccaagtttcattttgactcaagagctggtacattgcaccccttcatcaaatctctgtgtccacaatctcataaactatcaaattctgggtatttaatgagagaaagcttaatattgaagtatctctcctatgaggtgttagaactatttgcctacaatttattggggaaaaaattgctcatttgtgtacataaacctaggacagagcacatagggaagataacattccaaaacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggtgagtctgagaaattgtggacagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacacttatcatttactaacctagtgaaggttgaccatacctcaaaagctgtattctcatggtaactgcagggaaacttgagcacattttatgcaaaattattgaggacatgcttttcatgatcactgttcactgtgtgtcctgagagcacaaatacagagtgtcctttgattccctcatcagtgtgtcacctgaccaattcactgagctcgctctgtgtgtgtgtgtgtgtgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctgggactgtgtggtttctgattccccctggcttattctttactttttcccacttttccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatggatcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcttgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattgtgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgaccactgttcgttgtgtgtcccgagcgcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatccgtcctttttctttttaaacagttccttatgttagccatgaaatctagctggggctgtgtggtttctgattctccctggcttattctttactttttcctacttttccaggctcagcagggagctgctggatgagaaagagcctgaagtcttgcaggactcactggatagatgttattcaactccttcagattatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcataaaggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgagaagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatcactgtatgctgtgtgtcctgagggcactaactcagagtgtcctgttactccctcatcagtgtgtcacctggacaattcactgagctcgttctctctctctgtgtgtgtgtgtctgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaattggccattactgagctgagagatgtcattgccgcagtgaggacctataggcacatgtaggttgaatgaaactctagttctacctggaagcccagacaagggatgggtcagtgagcaagactctcttcctagtctcaggccatgcctgtggcactctgattctactctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaaattgattggaaaaatatggcataactgtttgcacaaacttgggacaaatgttattgggataacgatctactagaatagggacactttacccacagtttctgggagaaaaactgaggaatttatatcatgaccagccttcagacctcctgaaatatatctctcatggtgtcgtattcttatgctgaggagcctgaggtccctgtgtgaggattagacagtggattgttatatgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagatgacaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctgatggccactgcatcaaattttgagcatattttatggaaaactattgagctcactctttttgtgatcacagtttgctgtgtgtcatgagggcactaactcagagtgtccttttactcccttaccagtatgtcacctgggcaattcactagctcactttctctctgtctctgtctctgtctctctctctctgtctttctctttcattgttttctacctggccctgttctatcccaacataaaggcaataaattttttttttttacctcattaatgaatctatcctttttcttttctaaccacttccttatattacttctgaaatctagtggggctctgtggtgtctgattttccctggctgcttctttagttttgtctccttttccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtttattttctaatctcttccacattgtaggctatgtttaccatacgtagcagaatgtatttacatttcttggttctagtcatttgtattcttcgtgagtgtgagtgtgtgtgtgtctgtgtgtctgcgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttcctacctcctttacctgccccttctcataatagtatttgaacctaaacatataccgttgacattctgtgattatcatcttgcccctaccttggttttggtttttggtgcagttccaggctcttggtgtctttgtttgggacaccaagagcctggtactgccacggcaccagctggtaagaattaggcttttttggccgggcgcggtggcttatgcctgtaatcccagcactttgcgaggccaaggcgggcggatcacgaggtcaggaaatcgagaccatcctggctaacacggtaaaaccccatctctactaaaaataaaaaaaattagccgggcgtggtggcgggcgcctgtagtcccagctactcgggaggctgaggcaggagaatggcctgaacccgggaggcggagcttgcagtgagccgagatcgcgccactgcactccagcctgggggacagagagagactccgtctcaaaaaaaaaaaaaaaaggctttttttttccctaagggttaacaacaaaccagccctttggaaagacttgcttcaccactgttaccaaccaacggcctgatgctttccctcagttttgtgattttgacaaaacaagcaagcagcattccctcctgataagagaccaccgacctaggaatgattctggccagactagagaggatgcacagtgagggttttcatgtcctctgcttcagcttttgatgtcagagggccacaaactccactctcagatgattgctaatgccaccattttatgaacatggaccccatggagaggcacgaagctcaattgcacttctgcacatttttcctcctataaatattgctattggaatattatttggtacggctcccgtgaaagatacatttgcagaatgtactcaaattagaagcatcatgtaaagcctataatgtagcgatagtgcatcaacttccctacactatagaaatatctgcggtgtagacatttccacaatgaccagatatgtgtacaacaaaggtggctgcagcattctttgtaatcctaaaacaatgaaacctacctcatctcaaaaactttatttttttatttttattttttttttgagatggagtctcgctctgttgcccaggcgggagtgtagtggtgcagcctccactggtgcagcctccactgcagcctccacctcccaggttcaaatgattctcctgcctcagaatcccaagtacctgggattacaggcacatgccaccatgcctggctaacaaaaacattttgaaaagggttaaataaatcatgcacaaactgaggaaaaatactcttcaaaaatgatggagaggatcactatgatgatgaatgattccactggtcacattattgatagagcaatcagtaaatccaggcacatcctcgggatattactgacctcctattattaacatatgaaaaaatggaggcatgtaaattactcgtttaagcgtataacggactgaattagaattttatcacaccagaagtgggttcctaggtctctgtttcaggattcctgagttacacacatataaacccaggatttcaggagatacccggttaagaatccggtcggggaggtgggctggcccttgacatggataagtcacaaattagtggcttaggactccaggaagataaaatcttccccatttatctagtgattgacaatgcatgaatactttaaaagctcaaacaagcgtccctgggtgggctcgaaccaccaacctttcggttaacagccgaatgcgctaaccgattgcgccacagagacaggtactgtcagttctactgggcgctataggaagggcgcacgcacgaaacttcctccgtcccttgcaacctcagggcccgcccggcaggacgactgagcaaggccttggaaaaccggagagattggagcggtaagtcgcgctggtcacgttggacacctgcgcgttgggagattctggagccagaaggatagccgaatggccttcgcccgccctgcccctcgcctgcttcagaaaccccccggaaacgtcccggttgagaccccggcccgagccgcctgggggccctagggaggctgaacgcccggtggctcccgggatggctcttcccgttcttcgcgccgccttcacccagtgagggagcctgtgccctccctgcccagtcgcttttggggccgctgcggagcttccgctgccatcttcggatcctgtgttccgcacgggggctccaccagggcagggatcgtggtgagggtggctcgtgggtccccctcgcggggagcagggtctggcactcaccagggcgcaggactaggacttgtcgaatgaatccatccttttagcttttagtcctttgaagagccttgagaatggaaatcatgagagatttttccatggggaagttccttttacaaagcatttatttacgtggacttcttggcaccccgcggggcggcaacgggcagggcctccagtgccccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgctactattttatgattgcaaataattcggcagtgatcattcttgtacacttctcattggccatttgtgtatttctatagggtagaggcctggagagcagttgctccagcatagggattacacagtttttgtttgtttgtttgtttgtttatttatttatttatttatttatttttgagacagagtctcgctctgtcacccaggctggagtgcagtggcgccatctcagctctcactgcaacctccgcctcccgggttcaagcgaatctcctgcttcagcctcccaagtagctgagattacaggtccgcgcgagccaccacatcgggctaatttttgtatttttagtagagacggggtttcaccattttggccaggcaggtctcaaactcctgacctcaagtgatctgcctgccttggcctctcaaagtgctgggattacaggcatgagccaccgcacccagcgattacatgttttttttttatatatcattctattttctttccttatttggcttattagctgtaactctttcttttgttatgtcagtgatggctttagggtccctagaatacatctttatccgtctgccatcaagtgacattatacctccccttctggcctttatgctagtgttgtcagggaatttgattttggacatgttataaaccccaacatccaagtacgtacatagcgattttcagtcgtctccatttctttgtgtaggttcagatttctgtttggtatccttatccttaggcctggaggactcctttaatatttcttgtagtgtggttcggtgaattctgtcatttttttgtatgtctttaaatgtcctgatttcagtcacatttttgaaagatatttcaatttggcatagaattctagaataactttttttctctcagtactttaggatgttgccactttgacgctttgtcattgacatatctttcctgtttttgtaaacttggcataaagtgggtttcctgtacttgttatatgatttttggattgtgtattcaaattaaaagtattaaattaaaattaaaatggcctgggcgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtatatacacataaatatgtatatatattatatgtatgtatgtatatataagtcctacagtcaccttaagttccaccaacagtgcacttaaagtaaaatgtgcccaacctgaggctcaaacctacctgctggcacgcaatttgtgtttgtgagacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaacaaacttctcagttgcatccctggaatccatggaaagtccaggagagacaatcaagtgctacaggatcaagcccaaacagaacaggactaggcatggcttcctcactaggagtcaggccaaagtcatctcctttggtctccaatggaggccagaactcggttcacctgcaacgggaggacctggcccagaagaggtggccttcatcttcatggtgccttcagataggaaatctaggatttcttttcttctctttgatctacttccaactctccctttctatttatttatttatttatttatttatttatttatttatttgagacagagtcttgctgtgttgcccaggctagagtgcaacggggcagtctcagctcactgcaacctccgcctcctgggttctagagattctcctgcctcagcctcctgagtagctgggattacaggcgcctgtcaccgcgcccggctacttgttgtatttttagtagagacagggtttcaccatcttggacaggctggtctcgaactcgtgacctcgtgatccacccacctcggcctcccaaagtgctgggattacaggcgtgagccaccgcatctggccctccctttctatttcttcaagacctttttcggatccctcctgcgcaggacctaaacgggcggtgcccttacccactggtccctccctgcctggtgtcttcggagccctagctcacccggaacgttactgcccgccggtgacagcgagaggaccaaagaggaccaaagagggcagcgggtgtggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgccaaagttcagagaactggggttcccgctgcttgccacacagaaaaccgatcactgagacggttattgccaaggaagaggctttaatagggtgctgcagcggaggagatgagaactcagtctcaaatccatctccctgaccaaccaaaattagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacacggtgaaaccccgtctctactagaaatacgaaaagaaattagccgggcgtggtggcgggcgcctgtagtcccagctactcgggaggatgaggcaggagaatggcgtgaacccgggaggcggagcttgcagtgagccaagatagcgccactgcactccagcctgggaggcagagggagactctgtctcaaaaagaaaaaaaaaaaaagaaagaaaagaaagaaaacaggaactagggaggggcaaggaagcaatcaggatgaatgaggggtccggcgtctcattgtctgggtgactttcagttctttgatatcttttttgagaggcctgaaggaaggaactcaaataaaacaaatatcgagtttcaaactttcagatcagaagggtccatttctatgtttatccaaaaatctacgtatgggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggagtttgagaccagcctgaccaacatggtgaaacctcgtctctaataaaaatacaaaaattagccgggcgtcatggcgggcacctgcagtcccagctactagggaggccgaggcaggagaattgcttgaacccgggagatggaggttttaatgagccgaaattgcgccactgccctccagcccgggcaacagaccgagacaccttctcaagcaaaaataaaaacaaaaagctgcaggtggaaaaaaaaaagtctggattttggttcagagtccctggggccttcctcagtagttttctctttccttaaaaaaggaagcttgtctcagtctctgcatctctctgagtccttttggagattgaggatggtgaggtctcagtgcttggcccccttctaactctgggtacctcccctcccgtgggtcaacctggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgtctcttgtggaggaactgacacccgctggagaaagtgtggagggaagcgagggctgcacctgcacgcaggagctgaggcaagcggcggttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagacttagcagggtattccgccaagacataggttagactgcggttctgatctgcaggcctcgatgccctgcgccggggcaccagggcacgggcaaagccctccccctacacaaagcaagggtgttatgcctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgcaatcccagcacttcagaaggctgggcggaccacttgagcccaggaggtggagcccagcctgagcagaatggtgaaactgctacgaaaaaagaaaaagaaaggaaagagaaagaaaagaaaataaaaaaaaaaagagaaaaaactagccgggtgtggtggcgtgcggttgtcctactcgggagcctgagatgggaagatcgcgccagttctccagcctggacggtacagcgagacttgtcttagggagggggggaaaaaacaacaaaaaaaacagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaaggaaaactaaccgttgcgaacggaaacaactgaccggacagaacacagccacaaaacacgagcccgcaccctgagttacaaaaacacttacggctcacctactattcgcaccacagaagcaccaggggaaagcgcgaacgcagtcccctactatcacaagttatgcagtcgagttcctcacattgggggaaaatggcaggggtcagtacacccggaacataacggataagcctcgccctgagaaaaccaccttcgtgatcatggtatctcccccgccaagtaagtatgagcttttgcacctccgccccgccacagcctcacacgcttcaccctttacacgcacggtcacttgccccgcgcacgccccccccccccaccccccccgcccccagccctcctagccctgacacatagctgggactctcaggtccgaccagcggtcctgaacccgctcccacggcacgggaactccttagtggcgaagcagcagcccctgcgctgcctcatctacatagaaatcgccctatccgtgatgtcaccgacagcgcctttcccagacaccgtctgctcttccgccccaccctccgccgactcagccgatcaacccgctgccggagctggcggaggaagtgacgtctgtctctttctccttttcctcctgccattgtcctttggggaggtgcgcagagatcccacgtctggtctccccctaagactgtggtacttgatctgtgtcctgcagagaacccttctggcggccaacaggaagcttgtgcacccttcttcagataatgtcttttaatgcgcagacttgaacgtttaggattacaaggaaaaccggttcctttcaaacctgtttatctttgtgatgtagcattccgtttcaagttgaaagccattcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatgttagtattttatattctccaaagacacaaagataatcccaatttgacaaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattcctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcccaactgacattacaacagcgatctcaagactttttgtagcaataagacaccaaactccaggctgactctagtgtagcattacatgacagatagcaggccctgaaagaaatgaaaatattttaccctaaaatacattttttatcatattttgaaatgtccctacaaagttgtctcttgtggggaaagtctacatgctatagggaatccctttccaggccttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccagtcaaagtatcagaaaataacggctggtaactatgtaattatgcatatatatgagtagaattttgggggtggacacagtggctcatgcctgtaatcccagcactccctcaggaggctggcagattgcctgagtccaggagtttgagaccagcctgggaaacatggtgaaaccccatctctacaaaaaaaaaaaaaaaaaaaaaaaattagccaggcatggtggtgagcacctgtggtcccagctactcaggaggctgaggtgggagggttacttgagcctgggaggtgaaggttgcagtgacccaagcttgcaacactgcacttcagcctggatgacagaggaatggaccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcattcagtcttggctctggtgggaaacaaggggcacactcggatgtgtgatttaaagagagttgtgttttttttttgtttttttttttgagacggagtctcgctctgccgcccaggatggagtgcagtggtgccatctcggctcactgcaagctccgcctcccgggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctgggattacaggcgtgagccaccgcgcccggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagttctgtccagtgatcctccccaagacaaccgttctctctagtaactatggttttcctttctcatttcaattgccacctcaattgactgaaatgtgaacaccaactcccgcacttaaacgttgaagccctaacacctactgtgatgatttatgcagctggggcctttgagaggtaatcaggattaaaagaggttatgagagtggtgtcctcatgctgagattaatgccattacaagaagacagacactagaaagcttgcttgtccgccttccccctggtgcacgaagaaatggtcacatgggcacacagtgaatctacagccacttacaggccataggaagagaccttagaaagaaatccgctttgctaccacctttatcttggacttcccaacttccagaagtgtgagaaatacatttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtgcccttgggtataaatccaacttcttcattttaatggtgagaaaccaaaagcccacgtttcctgatttctggcccagcactggaactgttttcatggcacgtcaattcatcatacattttaatagtgatattttatatttgcataattttattgcctttgcaatgggctttcacatctatcttctcatgtgtatatagtttagaggccatttttacccactatttcctaatcatatcgaccacagcctcaggaaatgtctgctctattatttcacttgcctgtctgggttcttgggcaacagcatagaatcctgcactgtgttttccctcacgctttctcactctttgcagaacaaatttttgttacatgccttattatcatggtaatattggccttcagtcctgtatagaagcattaaaaatgtgcgtaatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacgttgtctttctgtagtgctctagcattttctaagcattttcacacactgttatctctttttttctttctccttctagaaattaattatgacttttcctttcaaaaatgaaggacttttttttttttttactcttttcattttttcctgagaccatatgtcaaagggaatgtgagtaacaactttggtgtggtaatagccaaattcctccaggtctgctcctcaagcttgcaaagtcaagactggcagaagtggtgatttttacctgggtatcctgagaaccttgcacagtccttatcacatgcaggtgttcagagtgtgcaaataaacgaagaaatgtgagattgtgatgatattttcatggcatgctttttttccacacttcctcatgcagcccaacatcctctacaatgtgttgttctacccgtttaagtgatttaccacttctccattaagccaacttaaaccatgttgccttcaactcaacattgattgatcccctatacagtcctgtagggaggcaagaaaacttacaaacgaagtggtaaagaaagagagagattaagcaatttgccccaaatctcataaccactaggtgataaatcttcaactagaactcaaatatctgactgagaattcagtgcttttttcatttaaatcacattgcttcataaaaatagatctgcaggaagaataaaaatgtccaaagtgcaatgagacagagaagataatatggagacagacatattgcacagaaagcatttgaccatatgtctgcctgatctccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatggctttaatctcttatttattttgactgttgagattttgtagccattatccaaataaaacatttattttcactcgtgagtccctaatccttcgtcaatggaattagctatttatttgatgcaatagctagaccagtagggttaaaaatgcttttataaagacattaatagctgggtatggtgatgtgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaacggaaactagaaatcattgccatcagctttctctaatgtgtacttgatccttttctccctgtgatggaagtcgaaagtctttttgtttttttcttaatccactactgttcaaatgagaataaacagccaaatgactgaattagttggtagacataattcctagtcttcaattatttttatattcttttgtaatacagtcattattttttcagacttctataatattgcatttaaccaatccccaaatagggaaacgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctacccagatagagagaagtcaggcagggctgtgctgtgaaaatattagagaagcttgatgggaggcctaatatagtttgtctttacacctgtatattttgcttcttgcatctgcttcaatgccctctgtcatttattataactagatatattgttctaatagatttgtactacagtcagagcaaacaaatcactggatccagcagaagccttagatatatgacataacagagatttgcacaaagatttgccccattgccttctcaaatttctcttatcatcaatccatctagctggagctctctgaaggtcatcagaggtcagtataattttaataagattttaactgaaggctagccttgatgttcagtgaccttcagacatgtttataatcgagaagccactccccctgttgaatgataacctcttccatgaattaccaaaccaatggtgctcacattctgattaacgattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttagcatttgtcacgttagtatacagcttctctaactgtcatgaaatgaaataaatgggaagaagatgaaacatgaaaagaaatctgcttcttaaggcaggccctgggggaatagccctggctggaggtaatgtaaggtctagatggtgtttttagaatctgaagactgcaacaccaaacacaacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaatggctaagaaatagtaaaattaacacatggcctaaaatattaagaaattatgcctgttacagaattacggacctggctagtatataggagcattaacaacacaaaaacagattaggtcgggattagcagtgggggtgaaataatcttcagggctgaactactgagctagaaatatttaaatcctccttgcagatgaaaactatagaggacaatttattggttcagcatgaatttctggtcttctgttaagaaatacgctctttcattgaaagtgaacattgaggcagtaaactccaaatacagctgcaggtactatctcctgctgatttgtgtgtatagagcatgaaagaaaggctcagaaacaaaagcatgttggaaaaataagcagaaggagacatttacttgcaaagaaatgtgaggaagtcattcttcaaaagaactgcccaaaaaattaaaaaaatagaactttttaagacaaacaatattatgaagacaatagggcttatattaatctcttcatggcagaaaactgcaattttatcatggttattgtattcagaaagttcatgacatatcttcagacaataaacagcattgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaacgggccgacaatggtgtcaggccccgatgtcactttggtttttacacttcatcttgcggtcatgtttccttctctacaggacatgtttgtctacctccatttgctgaacaatgttcctaatcagtactattgattttacattttaatttgatccattttatttgcacagatctaagaagtgttgattaatatttaatgacctcctagtatttttttgatgaaacaataaactaaggctcacaagtttacgtctatctatagatttataaagcccttgtgctttaaatttacttttacatgtttaacagctcagtttagagcagaccaaaccagtccgttcacctctacctgatttcatctgcagtatttataatgcaaatgtatcctttttaataaaagttatccaatgtctcggtgtccctgctctgccaagaaaggacattctttcttacctccaagcctgagattgcatagtccatagagcaagcaccagattggtttcctagaaggatgttataggcatcgcttctgcatgaaaaacatagaaattattcttattactggatttgtcttgtctaattaaattgaatttgtagcacagctataaattttttattaaaaaattgattcttcctggctgggcaaggtggctgatgcctgtaatcccagcattttgaaaggctgaggccggcagatcacctgaggtcaggagtttaagaccagccaggccaacatggtgaaaccccgtctctataaaaacacaaatagtagcctagcatgatggtgggtgcctgtaatcccagctacctgggaggctgaggtgggagaagtgtttgagcccaagattgagaggttgcagtgagttgagatcacgccattgcactccagcctgggcaacagagcaagactccatctcaaaaaaaaaaaaaaaaaaaaaaatttctaatcagtaatatattcaggtagaagggaggacaaattcttattgaaccaatacaaataactacatagtcacataaagtaaatgtttttattaaagaaactttgtgcaagatttaagcaatattgctaattaagtgtatgttaatagacaaaaccaaatattgtatgtcacaattctttacaaaataattatttgtatgtttttcttggcaacttattagctttgtttttatattaagaatttctgcaaggtatttttttcctcaacactaagaattcagagtgttttatttagtttttacaaatttaataatttgtacatttaattggagattaaaggtagattaagaagaaagaaaatgggtttctctcatgttcattaaagtagaaaattaaactagcctcaattaaattgccttactgaggccctttaatcctaaataacaacctcttgtcgtgctggtcttgagttaagcagtctactttcatgaattcatcggcttctacactgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatacttcttccagatgactcaaattctgattggcgctttgtagagaggcttttaggtatgcttaaagggaaaggagggctgggcacagtggctcatgtctgtaatcccaacactttaggaggctgaggcaggcagatcacttgaggtccggagtttgagaccagcctggccaacatggtgaaaccctgtgtctactgaaaatagaaaaattagccatgcatggtggcgggcacctgaatatagctactcgggaggctgaggtaggaggacagcttgaacctgagaggtagagtttgcagtgagctgaggtcataccactgcactccagcctgggcaacagagcgagattccatctaaaaaaaaaaaaaaaaagcagcggggatagggggaggagatgttgctaataataaaactgtaaagtttggttaattttttgccatagcaaacaacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattataacatagccacagtaatcatacataattattgcatttaattaatttaagatgattttattgctattttctcagaatatggccttgaaaaacacagcagcttccactatattgagcatagttttgagcaaattaaacatctggagaatgcaaaacattacctttatttctaatatatcttcatgttaagagctaggaggaggatctctggagtttcccagcagccatctgagaaacccagagatactgtattcataagtaacatctcagtagttttactattttggatttgagggttaaatttggggaatatggtatcaaaaacagtgtcacaggtgggggctgcagatgtgaagggcctgctatcaatcaggtgaccctggatggactacccactccctgtgtcagtccaggatcccagctgtagtgggttcctctctgctacagcacatgtttctaaagggcaagaatctgggctcccaataactgacctctgtctcctccatcctggcttgtcatggtagacccgaaccaccctcccattgaatttgggcccttgtggctcatagccacaagggaaattgggagctcacatgtgaaaggcagaattaagttaatgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggaacaagaaagacaacatgacttctggaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctgtattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgttgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcacctgtaatcccagctactcaggaggctgaggcaggagaatcactggaacccaggaggcagaggctgcagtgagccaagatggcgccattgccctccagcctgagggacaagagcaagactttgtctcaaaaaaaaaaaaaaggttaatatatggagattgatttatcattttatcaaaaaggtaacccaaatactaatatgacttttttgagaccatccatttaacaaattggactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagactcatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccatgtagggtatgtgtggttttacctatacagtataattatttgtagccccatctcaagttacaggaacaaatgttttaaaaaatactagtttaataattcaattcagctgagccataaatccagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttaaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaattcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctatcaacagttagagctctccatttttcaagctatgcaagattgtctccaatagttatggcttcagcagtggttcagcttgagtgtgcatcagaaccacctgcaaagcctaattaaacggattccttggctcacttggcagtatatgactcagtaggtaagatttgagaatttgcatatctaacaagttgtcgggtaatactgataccgatgtctagggactatgagaatcactaacctagagtgtttaaaaaatgaccaatttctgtgcccaattatctgccaaagtttcctaagagaaggaaaacaacaacaacaaacaaacaaacaaaccaaaacagagagaaactgagagaaacagccacaactggaaactagtaacacaaaaacaaaccattgtaaaggctaattaacttattttcataccaatggggaaagatttttatttcattttgcacccacaaaaagctttaggagttttttcatgtgccagaaggaagcacataacctccaaattcacaatctattctttgcccgtttgctgtagttactctttgtaccaaaggttctgagtctggagtctctgcttccactggtcagatagactctctccttacattgtggtctctcactgaatgttctcacccactgcttcctcactacgtaatatctgcccaagaagctcccgtcttctcattctcccatcccatatgctgacattctttccagtccctgcattgttatgagagctcagtgggtgagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatacaaggtaagatcaacatttgaagtgattgagtttaaacataaaaagatgtattggctcctgcgactgggcagtcttcagggttagttgcttgagtgatcaacgataccattaagattatgattgggacatgaaaaaaagaactggcaaataaggagagaactttgacaatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactgagaataatcatcacaccattctgtctcacattctagaaggctttgtagtggtagaactgtaaacaacatataaacatttctgaaatattgtggttgttttatcttccataaacctcacacaagccgtgtgtatgatcatccatcttctgggccattatctgattattgctgctatctctcgctttggggaaaggaggtctctttccttatcaatactattggatcagctcttctaatttcatgatgacatgagtgttcaggaatgatggaaggcaaatgtaactctgagaaaacttggtttaactactgcatttcacaagtccatatccatcctagaaggtcttccagcctgctctctgccttgctcccaagatggccacatgtaggtctcttctttcccgtaaccagagggttatagattatattatccttcaaagtctgggataaaccaatttctcactctaaagagaacaacgtgttttgatttttccaaccctaaccctagcctaaagtctaccttctaatcctatcttattacaaatgtccctggattgatctttcaagggatttttgcctactgaaaaaatattactctcactcaaagaattgtggcctgacaagaaatctacaagagtcttggacacagaggccaaaacatcataacatctggattattcaggataaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatttctacttccttgaaattttattgagaaatccatcattttccaaacttttctttctattggtgtaaaacagggatgaatggccatgagcacttcattgcctcatctcaggtgacacttctttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatggtttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaggaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaaaaatatatcagaaaaagttttggagaattgcaattgaaaaaactagcagactaactgcatagcctagaatataaaaaaaaaaaattaagaaaaagctatgtacatcctgaatgcataaagtatatgtatatattaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaacaatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatcttttggaatattctccagcgtctactttccagtgtatgtactattataataattttgtagccaccccctgttgctactgtggtgagctcatgttgccagtatctgccatgagcacttggtctcttcagtaaattctgtatctacgtaaatagtgtgttctctcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaagatcccttaaaaaaaaaaagagaaattcataaggcctcattttgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcctggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacctcagcctctagataagggagtcataaggacctttaaggctctacatatggcactctatggaaaggtttgtcaacattgcaaaagagaaacccaatagagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaacagcagtgccagaaaacaaattggcattcaacaatctggcaaaagaactttgattattcaagactacttttgacttcttttatgacatagaccgttccatgatacaggaactgaaactgaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaacacaacaatgatgaagacctttaggatgatccacctccacttaatgaatgggtcatatattttctcttccttacaattttcttgactataatttcttttctgtagcttagtttattgtaagaatacagtatataatacacatagcatgcaaaatatgtcttaaatgtaacgcatgttatcagtaagccttctggtcaacaataggttattagtagtttggggggaatcaaaatttgtatgcagatttttcactgtgtgggaggccagctcccctaaccctatattgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcatccctgaatccttatcagcaatgaatttttaaatatactataagagatgaaaaaatttttttaaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttaaagaaaagagtctataagacaaaggtcctcataaattaagagaagccaagacagtcactgtgactgcagaatattttaatttttttttattatactttaagttctagggtacatgtgaacaacgtgcaggtttgttacatatgtatacatgtgccatgttggtgtgctgcacccattaactcatcttttacattaggtatatctcttaatgctatccctcccccagccccccaccacagagcaggccccagtgtgtgatgttccctttcctgtatccatgtgttctcattgttcaattcccacctgtgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccgcaataaacatacgtgtgcgtgtgtctttatagcagcatgatttataatcctttgggtatatacccagtaatgggatggctatgtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgacggccagtgatgattgatgatgagcattttttcatgtgtctgttggctgcataaatgtcttcttttgagaagtgtctgttcatatacttcacccacttgttgttggggttgtttgttttttcttgtaaatttgtttgagttcattgtagattctggatattagccctttgtcagatgagtagattgcaaaaatgttctcccattctgtaggctgcctgttcatgctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtataaggtgtaaggaagggacccagtttcagctttctacatatggctagccagttttcccagcaccatttattaaacagggaatcctttccccatttcttgcttttgtcaggtttgtcaaagatcagatggttgtagatgtgtggtgttatttctgagggctctgttctgttccattggtctatatctctgttttggtacaagtaccatgctgttttggttattgtagcctcatagtctagtttgaagtcaggtagcgtgatgcctccagctttgttctttttgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcatttttaaatcctttcagcacagagacaatcaactgactgtctgggtactacctgaccactattggagtctctttcatctgcctgagtctgtgcaacaatatgaaaattaattttactatgcacgtaaacgttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacggtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtcttccaatgtgttttcatacattttctttctgggatcttgagtgaaacatgtggatttagaacaagaacaaaatgatgttaccttgatgatctctatgtagggtcacactcaaggcatcttaaaatattttgctggccaacaaaagacacctcctgttctaattgggcattgaccttttctttaaactatgcagacaaacaatattataaagtgagaacatctgcataaaaaacctaaacataaatcttaatagtgagttcatgaaaattcttactgatgaaatggcaatgtcacagactgactgtttatgtccccccaaatttgtatattgaaatcctaacccccaagctactcgtgttaggagacagagccttggggaagtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccgtttactcactgttcctctttattttagtttcacatttttgctatttatctctgtaattttattcattcttcacaatttgccattcttatacttcgaatcatgttatcagtttataatacctccatcaaatgatagtctgcatttgtttatccttggctgattcaaaacacttggcataatttccttaaaggaaatcatcttcatcccacctcacaacactgtattattttcaattaatttccaataaactcttaattgtccatgctctgtcagagttggcagagttaatccctgtttaagctaataggttcaacttcttcaacaaacaaatctttcatgaaagctgctgacaagccagagtattaattaaatctagtttcattgcttctcactttccttgatccttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcgagtacagtatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttattcatttaaacagcaaggtacatttcattctacagatatactatataatatttactccgatctctggatgagaatttatgttgcctgtaaatattgtatcacaaacattataagaataatctctctaaaggttttcttcctgaattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacaaataatgcaatattatacaagggagattaataggtagaaaaagaaatgcaatggccaggagtaacagaagatgttcaacatcaatccaatcaaattaatgcgtctttaaaatgcaatagcagtcaatgttagcaagagtgtaggtattagacattctcataggaatataaactaaggccatgttttaggatcatattagatcgcagcaattaaaaaatgttaaattcatatgttgtatagcaacttctcaggttggaatttatcacatggagaatcttgtaaaatacataaaccaagatatgttattaatgttattggtagcctattgttttaataaaaaatatatttatacaatacagttgttaaaagttaagaatatcttgaaggtaaattattaaacaaaaatagaaagcctaggccaggcaagacttcatctcatgcttataatcccaacacttttggagactgaggcgggaggattgcttgagcccaggagtttgagaccaacctgggcaacacagtgagacctcatctctagaaaaaaaaaatacaaagcctagttctgaacatccttttgtgtaatactaaaagataaaattttattttctatcttgtttaagatctatattctatacgggggttgtgtattaaggtcatttttaaaaagatactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaatggtatacattttttgattcaagctaatttcatgttacgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccatggttattaatcagtctcactgactacattttccgttttacatcccctttcaggcactactgcagatggccaagcatatcacattatgtaaataaaataaaacaaaatcttttcccattgagcaaatggatatacttcacctctaatgcttccagtctttctcagatcattcaaaaagcatgatatggtttccatgaaaggacattcatcccatttgactaactggaatttctttactccagctaatctttaccaaagagctgaattaattcaagttgacaccctgttatctaccagctcttccagcccttttgcttgattgttttgtcattttgccttttcttttcttctaaagtgggagtatggagatttacccttctgaaacagctgtgtcacatcatgatccttgagaatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggggcccagtgggagataactgaatcatgaggatgggtctttcctgtgctgttcttgggttagtgagtaagtctcatgagatctgatcatttttaaaatgggagtttccctgcacaagctgtctctttgcctgctgccatccatgtaagatgtgacttgctcctctttgtcctccaccatgattgtgaggcctccccacccatgtggaactgtaagtccattaaacctctttcttttgtaaattgcccggtctcaggtatgtctttatcagcagcatgaaaacagatgaatacaacaatactgtaacaaatcgactcacatctgttctctttataggaattgcagtgctacaatattagtggctcttaattctaagagtgttaaaaaatattaatgcttctctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggacagagaggctgcattaagctatgatcacatcactgcactctagcctgggtgacaaagtgagatcatgtcaaaaaaaaaaagaaaaagaaaggagaaagaaaggaagaagaggaaggaaggaaggaaggaaggaaggaaaagaagaaagaaagaagaaagaaaggaacaaagaaagaaagaaagaagagaaaaagagagagaggaagaaagaaagagagaaagaaagaaaagaaaaaggaaggaaagaaaggaagaaagaaagaaaaagagagaaagaagaaagaagaaaaggaaagaaagaaagagagagagaaagaaggaaaagaacgaaaattcaagtcctgccttgtaaaatgcagtactccattttcccaaagagatcccaagggaaacttaactacaggataaagacagacaaaaggacataaattacaactactctaggttcacatattattttgtttctgaaatgggttttaaaatatctatgtcagagttcatttctagaactttatctctagaaaacatattttcacttctcaatacaggaaaatggagattggaaaaatgagtttggaaaatgatttccatgcttatctctcagcttcttttttcaacttccctttttcatctccgtatcttcactgatacctaggaatctctgttacatcacagtcttcaagagctttgctcacagcgaattagttaagacattagctttcaaaagtatatgatattctctcacaagcatttgtctacttttaatagggcaagctacgtaaagatgttaaatctcattccagaaataccacatctattctacctatttatgagaacagtcgtctctagaccaagatagaaattcatagttaggaaataaatccctgtagggtttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaatgttattttactgaattactcattgctgttttctcattttttaaataataaacacttattaagaaacattggaaatataccaaaaatagtaaacaataaaacagaaaccattggcagaaatagtcactattaaaatcttaatatactcccttccaatgttgtttctgttaatgcaaattaaaaaatcagagattcgcctctgtgaactagatctctttttacctttagatattatttgacaaatacatagctcaatcatctatccaaacttctcttttacagactccatgccaattaaccttctcctatgaaactattatttcttcacataggataaatatggttattgacacacaaactttcttagttacactgcaatccagttgtgcgttcctaaatttataccaattggatttagaatgatcattactaaagaggcttggccttatctcttgcaatttgcttcttccttcttaaattcaattcttgtaatgtaactataatttgggggtatctttttgcctcatattcaaattctctttcaaactgaggtacatttctgtatttctgtatttgtatattgcatataatagtatagaaaacaataatgagattatagtgtacataaaagttttgaagtataattaaatatttaatatataaatatattaaatatgggctgctgactcaccaagcctggtttggcttccatcacttgtgtaatcaatcacctgtattaaatcacctctgcttgaaagatgaagaatagtttctgatttataagcaaacactgaaagctcttctatttcttgtttgctaaacaagatttgtcaaagttaaatattttattttattgaattcactttttgcctctcctacaatgatgatttgcttttcctcctttaacttgttaatgtgatgaattatacatagtttttttttctattgttagaaatccttgcattcatggaacaaacacaattttcatactatattttttatagacttctaaacttaatttgctaacttttaatttaaaatgtttgccgttaggttcatgaggaaagttggcatgtaattttcctgtcttacgcatttctcatataacattggtatcaaggttgtactggcctcataaaatgaacgaacaaatggacctttttttattctggagttgtttttataaaatggaaataatccatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgacgaaaagccctcagatattaaatataaccttaaatataaccttcccccaattcaatttttcttttgcagatatgattagatactctaatttttcaacctctatttcacatatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaaattcagtttcaatctgcttaatataagatacatacactgtctcaatttatattcctggcacacctcattgattttttaaacatattaaacacagcttttatagttatataatcgtcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggttttttttaacttatacttacagtgaaaatttaaaccacaaattcatgtgaagatggccttctcatttttcctctaaatagcaccgagtttgaggcaggaaaatttcctggttgtctccccctgaggaacaggtttttatctagtttatcctttcactgaaattatagtccttcgtatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttagtttctattcaagtcagtaatatacttttgaaaaatgacatgtacattttatctggtatttgtagatttcatatagcaggatagtgattcagcaaatttagtctaccacaatgctgggaatagaattcccctaatttttgaaaacattatattaaatcatgtttattgccattaatagtcttataaatgtgcttttaactaactgcattttgtcatagctcattgtgattgtatatttaactagttcacccctacctcatgttttttgggagtgaaggttgtactcaactcattatgttaagtaatactacagtaaacatcaatctatacatgcattaataatgatttccaagaaagtagtgacacatggtcataatcatctttgaggctggtggtacatattttcaaattgcatctcagaaataatataccaatctgtgctctaatcagccgcatatgaaagtgtcatctttctgttctccaaccaatacaactactactgtttttatacctgcaaatctgacaaagatgtgagaaggcatcttatagtttcaatttgtatttctttggtgaccaatgtactaaattactcaatgtactaaattactcttttcctgtttatgatccatttcaaacaaaatgtaaaccattttttaaatttttttatattaatgcaaatcgtaaatcactactttatttattcaacttcctaagcaaaattatatgttgtcccatttatacattttatattagatctttctgccttacatttataacctaaaaactgtcagaactatataataatgatgaacagttgattataaataatgtctttattaggatatttctccataaatctaaatttcatcaatctttctttaaatatctctacacaatgtcctcttgtattatattaataattgcagatacacttctttttgctatttctattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcgatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataatgataccaattcaagaaggagaaaattgatgtactgataaacaaatgggcatcttaggatcatgtttctcacaagtaaggcagttccagaaattcctaggaccataatgggttttattctaaataggttaaacatatcacttaaaaaattgttttctacagttctctaatattgcttacaattgtccacgtttccatgtttataaacttgcacttttttttttttttatggagttttgctgttgttgcccaggctggagcccaggctggagtgtagtggcgtgatcttggctcactgcaacctccacctcccaggttcaagcaattcttctgcctcagccttctgagtagctgggattacaggtgcgtgccaccacacctggctaattttttgtagttttagtagagacggggtttcaccatgttggccaggctggtctcgaactcctgacctcaggtgatccacccgccttggcctcccaaagtgctgggattacaggcatgagccactgctcccggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcctctatctgcctcatgtaaggtgcaggtgacataattaggtaatcaagcaaaagatcacatattttaataagaaagagacactggctattattttgagtggcaaaacaggttattcagtcccagtttaaaatggaaatgacagagaccaagatgaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacgccagctaacaaaacatgctatccaggctctttcgtttcaccatattgctttcttgaaaacataggacagtgccagtttagcactgaaaaaaatcagttctcctaattctaaaaagaggagacagccaggcgtggtgggtcactaaaaatacaaaaaattagctgggcatggtggtgcatgcctgtaatcccagctacttgggaggctgaggcaaaagaatcacttaaacccgggaggtgaaggttgcagtgtgctgagatagcgccattgcactctcgcctgggcaacaagagcgaaactccgtctcaagaaaaaaaaaaaaaaagagagagagagagagaaactgtaatttcatttcagaagttttatagggtactatttccaattctttttttcttactccattaaagtgtaattagcagtatgtgaaaatttccactttatcctcaatcagaagcctctccttccaattagcatatattttttctattaactttgtaaagtgggattcttgttttatacatacccctggaaagtatacttaaactgtgagaccctgggattttatatttccaaatagaagataccatcctcttgtatcacaaaatgtacctaagatggtttggattatatttaaatattcttgaatgaaatagacttactgactgaagccaattattatatttttccacaccaaaataaatgcaataggaaaagatgacagttctatgtagtattcctgcttccatattgcacaaattagaaacatacatattccattatgttacagggtctagggctttgggaggacaaggctgcaggcagccgagattgtgccgctgcactccagcctgggcgacagagtgagatcttttctcaataataataataaaagtaaaaagaaatataatatttaatcaatatatgcacacacatgggtttatcatgacacacacgacatgtgtgtacagtgaaaaaaatgagtaaatctagaaacctgtattgcctcaatagctagctaagtacttcaatatgcatgtttatttcaacaattttgtgttaagcttcagtggtaaataagcagagtacactgaccataatgaatacttcttttgatgagggttatcactacacaattaaaatattacatagttggctgggcacgttggctcacacctataatcccagcactttgggaggccgaggcaggcagatcacctgaggatgggagttcaataccagcctgactaacatggagaaaccccttctctattaaaaatacaaaattaaccaggcgtggtggcacatgcctgtaatcccagctactcaggacgctgaggcaggagaatcacttgaacctgggaggcagaggttgtggtgagccgagatagcgccattgcactccagcctgggcaacaaaagcaaaactccgtctcaaaaaaatatataataataaatatatatatattatatataatcaatataatataatatataataaatatataatatgtattatacaaataataaatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgtttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctgataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaattttttttatttttatttttttagtttttttaagagacagagtctcgcagtgttgccaaggctggatgcagtcacgccaactcagctcactgcaaccttcgccttcagggttcaagcgattctgctgcctcagcctcccaagtagctgggactgcagaagggcaccacgatgccccactaatttttgtatttttagtagagatgtggtttcaccatattggccaggctggtcttgaactcctgatctcatgatccgcccacctcagcttccctaagtgctgggattacaggcgtgagccaccgcgtctggctgcatgaccttttaacttgtctcatacactcaatattctcaagatataccttccaaagtgcaaaattatggcactttgcagccctgaccactaactgagaactttgatgctttggattttggagacctcattttatcacctggtccttttacttcatgacttgtcatgctgccaccttttgatgggattgagatgaagataataattcccaactggtcaggaatattgtgcccctttgtttttatatccagatgcaatagagcctctgacacaccactactattgttcttaggatttggaacaaaatgcatctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcagcagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggctcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagataattagggactcggaaagacaaagactgaaggattggtggcaatgagttttggggaaaaaatatgtagatgaaccacagaaaatgagccagagtgtaagaatatttgtgcttaatacgaatgctcacgaaactatcatcaggaaggttatcaaatagatatgaaggtatgaaacaatctctttcaccaggcactacattgcttgcttagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttattggagctcctctatgataaaggcaacaaggaattttgtaaatggaatctacctttaaccttgaattacatttgctttacctgacatcatttttctctgatcgccactctccacgggtacattgaatgccttatatatactgccataatatcctgttctacatccttctcttaaaagaacttgttgtataacaaatgagtagatattcattggactcacctggtccaccatttatcctatcactaaccaaaattattattattacagaatggtgaatattttattaaagactcaatcacagtgtcagctggagacaatggcttataaggttgtactcatgctagaggatgtggtggtgtatcctctgaactagtaactaagtataagcttgtctggtgtctcctatataaaaaatacaacaatctttgatatttgttatgaatgttgaagtgactccttttgtcattacatctaatgatccactccaaatacttgtctcttgtctctgagattctaggtttttgcagaattagtaaccaaagggagagtcttagcagtattccattttacaatccatccttcgttagaggatgagagacttctatctagccttttaggttgcctgagacctttaaacaaacagtcaaaaatttaaaatttaaaatgcggctacactgtggcatggggtagtaaatcttgaccttaaaactggtatttgtaagaaaaacagaaagaattcagggatcccctttgatggctcctaattctatacagtcctgtaaatattcctgaagactaaccaggcatggtggtgcacacctgtaatcccagctactccagaggctgaggaagagaatcacttgaacctgggaggcggaggttgcaatgagctgagattgtgccacttcactccagcctgggtgacagagcaagactctgtctcaaaaaaaacaaaaaaaagaagaagaaagaaagaaagaaagaaagaaagaaagaaagaaagaaagaaagaaagaaagaaagaaagaaatgaagactgccacaacttggaagcaaccaagatgtccttcaataggtgactgcataagcaaactgtggtatattcctacagtggaatattattcagtgctaaaaggaaaaaactatcaagccacaaaaagatacagaaaaacaaagacattttgctaagtgaaagaagccagtctgaaaagggtacatactgtgatttcaactatacaacactctggaaaaggccaaactataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggatggcagagttgagttaagtttatgattatgaaataaaaactaagtaacaacaacaacaacaaaaaagctcagtggttgccaggagtttggggatgggtagggagataaacagttctgaaacaggcgatttttaggggattgaaaatacgttggtaataatgtaatgatgggtacatgacattatgcgttttgcaaaactcctagacctgtaccacacaaagagtgaactctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatttcacaaggcaaaaccctgactagcagaggtgttagctgagggcacatggccatagatgccaatagtgacctgctggccacttgcagaaaggagagcctttacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaactttgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaatatttactatttgatgtttgttcctgtgtttgaggaattcctcagcctctcagttttgacgaaaacaagaaaccacctcctgctttagaagctaaaatgtcaaatgcttgctttctcagcctcctttgcagctatctgttgcaaagcgaacaagtgggagtggtgctggtggctttgcagttagcctaggattgagcaattgctgcaattgttgctctctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaatgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagtgagactttgtttcaaaataaaaaaataaaaataaaaaaataaaaatgtaactggatagacctaaggatcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaacaaaatatatacttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagtttttttcatttggaacacacactcattccccagtatactaggggtaataataatttaaagagtttaattactttttactactagaaaactaattttatgtttggcacaaatttctgaaatgatattccactgcaaagaataatacctatatatggccagaattacttttcttctataacattaagataatacttgtcagcctgagcaacaaagtgagacctcatctttacaaaaaataaataaattagacgggtgttgtggtgatgagggtctgtagtcccagatactcaagaggctgaggtgggaggatctcttgagcctaggaggtcgcggttgcagtgaactatgattgcaccactgcactccagcctgggtaacagagcaagatcctctctcaaaataaaaataataaaaaaaaagataatattggtataattcagggtttttgcctcaatccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattaccccaaaaatatgacctgctgaatttctgctgtcatgaattgactaacatattttgtgcctaaaacctttacatttagaatctttttgtttcgtattggaaaatattgtaagtcctccatttattggtcaaaagcactgcctatttatttccatgcttaatcagagagactttccaatagttatttaatattatttacgttcattcacttgttgactataatgaggttagttgctatgatatctttaggtcattaatataataaaaatatgtcaacttttctcttccaatgtgtctttgggttattaatttttaactcaggtatcaagcttgtaaaatgtttaatggcttataataatgtctaacacatagtatccactgagttctgataactctggtttatcaaattctctttttttgtaccattctccaaatgcaatgctatttggttttatttttattttttaaaaatgtgctgcctgttttgagtctctaaaagtgtgaaatgctcagcatttcccaaatgtatttgaacatggagtgttatatttactaaaaagttaacaagcaagtattcccctaaacactctagcaaatactactagtacagacaaattatgatgtaacattatagtacattttaacttattaggttaattttggttgcaaacaatcaaaattcaaaatggcttgtataataaagagattttgaacaatagtataggctcaagatagcctaatgcagaagtttaataatgacacaaaataaatgcttcttgtcctccctgtttcttcactctaccttaagtgatatagattgaatgtttgtatcccccccaaaatttgtatgtttaaatctaatccctagtgtgatgatatttggcagtgggtcttcggggggtgattaggtcatgaggacagagccctcatgaatgggattagtgcccttataaaagagaccttagagaacttccttgccccttccaccatgtgaggacacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaacacattaggtctcagttttattctatggcttaaaatatcatgtcatgagtagacaacttccaatcctagtacctcctgcttcctctgctgcatttggaaagaaggcatttccctcttcaatcatggaatgaaaaagttgtacttcattctgatttgattagcagaaggcacacgttccttccatgcaccaattacaatgaccaagaattgggcatgggactcatgtcacttaaacattgtgaagctgagaaattcattatttggttaggagtgtgtgagagcagggaacactgaatgcttgagacaccaccacgatgtccactacatgtatttccatttcagtaaacatttccattaagataatgctagaacaaaatcagaggagtagatcttggtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacacctctacatatattttggaggcctttacacaaaagtgttttccctgaagggagaagagaaaagttgaatgcagaagtagaaaaaaaaattcatttgcacttgtagtatttatatctaaatattttatattacagatgtattaaaatttttataattttaaacactactttaaaacagggagatggtttaccttcaaaaaatttggctctcaactcaaagttatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcaaaagaaaaatagctggttttaaggaatgaagggccatgtcaactattggaagcatctttgaactggagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaacttaatttttttaagaagaagcatttgatctgccaaagagaagagttagcagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataacttcttgtccattcttgtatgtgttatggtttctttcttagaaagaagtatgctatactagtatacatactatttattcatgaaccttgcacttatcatgtaatcatatgtcttagtggtcttttcataatagatgtctctctttcccacgctgtcagtggtgattgcatgaggcattgtacagacgtaccaataattacttactctgtgtcatattgttggttattcagattgttttcactttgcccttgcagacaacactgcaatgaacatccttatgcatatattattccaaatacatcatcgtcatggctgtgtgagagaaatatacattgttgattttatttttttattttttataatttcaacttttgattttagatacagtgggtacatgtgcaggtttgttacatgggtatgttgtgtaatgctgaggtttgcggcatgattgatccgatcactcaggtactaggcatagtagttgtttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataatggcatcgagttgcatccatgttgctgtaaaggacatgattttattattttttatggctgcaaagtattccatgacatatatgtaccatattttctttatccaatccacagttgatgggcacctaggttgattccatgtcttagcgattgtgaattacactgctgattttaatagaaaccactaatttttatgccaaaaaaatcatcaatgtgcacatgctccaaggctgtgtgagcatagcccttttccttgggatgtcaacaacactgggttttatcaaaatataatttttgccaatttattagttaacaaatgctaactcagtgctatttggatttgaactaccactggtgctgagcaactttttacatagtcactggcaatttatttatctttctctgttgtttatctttttctgtgtaataattttccctatcttctactcttttaaacattaagttttcactgttttcttaataatttttaagtttaaaaagtgaccttttggctgggcgcagtggctcacgcctgtaatcccaacactttgggaggccaaggcgggtggatcacaaggtcaggagatcaagaccatcctgcccaacatggtgaaaccccgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactccgtctcaaaagaaaaagtgaccattttatctgctacatataattctaatgatatttctcaattcgtttatcttttaacaatggtaatatataatgtcttgctatttagaaagatttttaaaagtattttacataaagaaatttttattctttgccattaatatttgcaggtttggaattttcaggacctcctcaaaggccacctacaggaaatgctcttcaaagacatttcactttttccccacttgattgtggagcaaagactaacactggcaatgctttgaagtacttgagtcaaatgggtctctcatgtggtcattactatactcactctcaggctccaatgcaaattgtttccttacgccaactactcttgctttcctttaatagacctattcctcctgggctgtctgaaactaacatttaattgtaaataaagtcctgcaaatccttggtatctcaaagaaccctccttccatttagttttaggagaactctccttctaaaactctattcttctccctggagtccagatccccattccttgcaacaaatgaacgcttgatttgagcactgaagggagataattggaagtttgactttgtgttctaggttttccctgccaatatatgcagcgtctttaaaactaattgggctgaggcaggagaactgcttgaacccaggaggaggaggttgcagtgagccgaaattgcaccattgaactccagcctgggtgatagagcaaggctccatctcaaaaaaaaaaaaaaaaaaaaaaaaagaaacagcaaaaagaaactaattaggttcaagaagttcgaatgaattcaacttagacaagctcttaagcagacatgttggaagttccagaaaagacagtttgggaaaatattttattaaaaaaaaaaaaagactgccctccacttcctcactctttcttcccacttattttcactccactggtgcagtttggtgtcaactctccccactctactgaaactgctgcagccgaggttactagttatttaattaacaaaagcaatagattttgttttttttaattgcattatactctactattttgtgacatttaaactattgacaatgtctttcttgaaaatgtgtcctttttgttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatatgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataatcctcacagtaattttatgagataagttctatttattatccctatcttaaggatgaggaaactgtggtttaaagagcttaagtaatttgggcaaatcatgaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagtttttagtgcatagcatagggcttagaaaggagaaaatgatgaaaaatatttattaaaataattgtttttctttgatagttgttataaccatcgaattgtgagtgcttaacaattactataaaggagaatggaaatcacagatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggtgtgcaccaccatgcctggctaatttttgtatttttggtagagatggggtttcaccacattggccaggctggtctcaaactcctgacctccagtgatccacccatctcagactcccaaagagctgggattataggcttgaaccaccgtgctgggcctttcttagagaatttatagtttacctggaaatgtaaactatatatatacttaaactgagggatatttacaaaagagctttctacttaacccacaagaagctgtattaataacaaagcaaatcaagcttgttcacaggcaactgaatggaatgaatggttttgattggtgttgccagttatatttctaacaagagaaaattcaatgtgagcctcatttggaaacaagatattacagagaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaacatttaatccctggaaaaaatgatgacatcacactgaaatcttgactcataagagaacttttttatgctgttccctaagtcagtttatttctacttcattcttgcgttaagggtaggctcaattcttactcattcaaaaacggtatcacctgaagcttttctttaattcttgttttctctgcagtgagaaaattaatcaaggggttaaaatgtatattaaattatatatgtattatatgtaaaagttatataatatagatcagagaagaatatattgcatatgttataggctgaattgtgtcctttccccaaattaatatgctgtaccctgccccctgccatcccagtatatcagaaggtggctatatttggagatagagacttttaagaggtaactaatgtaaaatgaggtcacatgtctgggtcctaatccaatatcactggtgtccttatttgaagaggaaatttaggtacagacatacatgtgcacagaaaaaagtccatgagaagacaagatgagaaaatgactatctaaaagccaaggagagaaatttcagaataaaattaacacatctgatgccttgacctcacacttctagcctccagaaccgtgagaaaataaatttctgttgtttaactcacccagtctgcagtaattgttataacaaccctagcaaagtaatataggaagtatatatatatatatatatacacacatacatatatatatatacacatatttgtgtgtgtgtgtgtgtgtatatatatatatatatatatatatatatatatatgtgatagagtagatagatagagacatatacagtcatccctcagtattagtggggtattgcattcaggagccctgcatataaggaagtctgcacatactcaggtcccacagtcaaccttgcagagctcgcatatgaaaagttggccctccacatatgtgggtttcacgtcccacaaatactatattttcaatctgtatttggctgaaaaaatccacctataagtggactcacacagtttaaaccagtgttattcaaaggtcaactgttgatatatagatatataaatatctcatatgtatagagcaagcgagagaaaaaatctctaatctctcttccttcctgctctttttggattgcaaactcttctctcataagtacaaaaagtaatgttaacaaagtaaagagaattggaaatagtagtgtttttgaccactagtgttttgtaattttggaaaaaaaaattactgaaatgtaactttttatttatattgagatgttttgactcatactccaatcatacagaaataatagataaaatatgaaaaagacttctttttacatacatagctggattaaaatattagaaataattttcttccctcaaaggatcccctatttaataaacggtgctgggaaaactggctagccatatgtagaaagctgaaactggatccctttcttacaccatacacaaaaattaactcaagatggattaaagacttaaatgaaagacctaacaccataaaaaaccctagaagaaaacctaggcaataccattcaagacataggcacgggcaaagacttcacgaccagaacaccaaaagcaatggcaacaaaagctaaaatagacaaatgcgatctaattaaactaaagagcttctgcacagcaaaagaaactctcatcaaagtgaacaggcaatctaaaaaataggagaaaagttttgcaatatacccatctaaccaaggggtaatatccagaatctacaaagaacttcaacaaatttacaagaaaaaagcaaccccatcaaaaagtgggcaaagaatatgaacagacacttctcaaaagaagacatttatgcagccaacagacacataaaaaatgctcatcatctctggtcatcagagaaatgcatatcaaaaccacaatgagataccatcacatgccagttagaatgatgatcattaaaaagtcaggaaacaacagatactggagaggatgtggagaaataggaatgcttttacactgctggtgggagcgtaaattagttcaaccattgtggaaagcagtgtggcgattcctcaaggatctagaactagaaataccatttgacccagcgatcccattactgggtgtatatccaaaggattatacatcatgctactataaagatgtatacatgcacacgtatgttaattgtggtgttattcacaatagcaaagacttggaaccaactcaaatgtccatcaatgatagactggattaaaaaatgtggcacatatgtgccatggaatactatgaagccataaaaaaggataagttcatgtcctttgcaaggacatggatgaagctggaaaccatcattctcagcaaactatcacaaggacagaaaaccaaacaccgcatgttctcactcacagatgggagttgaacaatgagaatgcatggacacagggtggggaacatcacacactggggcctgtcagggggtggggggctgggggacagatagcatcaggagaaatacctaatgtaaatgacaagttgatgggtacagcaaaccaacatggcacatgtatacctatgtaacaaacctgcatgtgatgcacacgtaccctagaacttaagattaaaaaaaaacatttcttccctcatgaggtacaaagccaagcattacactggggccatgatagtccaggttgctgaaagatttagatctaaagactgaaaattgggatatatattgagagagagagagagagagaacaaatggtaacctaaatttaataaaataataatagacaaattagggtaacaggcatatgagtactttttgttctaacaattcttttattttcaaacttatctatgatcttacatttatttcccaataaaaaggattttaagttaaaaaaagaaagtttttctttagtaacattttcacaactagggcctttaagactgaggaaatactccaagctctgagcaaactcagtaagtataaatccatatgtagacataccacagtaaaatgcaagatactaaacactaatacaatattttcaaatcaaccagagacggaaggcagattacctgcaaaggaaggacaattactttatcacagacttctcttcatcaacgagaacagacaatacaggaataacatctcccaagttgtgagggagactaacagatgacatgaaattctacgaccaaataaagcataattcaatgggcagcagttaacagaattaagctgtttccagacatctatggagagatttaactcaaagatgtcactgtaaatttgattgttgagatgtagtaatggatacttggcaaggttattgaattagttaaacgatcttcaaagcttaggtcatgtatcttcattaaacacatggtgctttgcatttactaaagaagggcctccgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatggtgtcaaccgcatagcagttatttgattggcccattcctttataaaatattttatgcttagatgatgaactccacataaattcagccaggagaatgttttccttggcaatctctgggagattacaaatgttcctttttttttttttttttttttttttttgagatggagtctcgctctgtctcccaggctggagcctagtggcgcgatctcggctcactgcaagctccacctcctgggttcacgccattctcttgcctcagcctcccgagtagctgggactacaggtgcccgccaccacgcccggctaatttttttgtactttagtagagacagagtttcaccgtgttagccaggatggtctcgatctcctgacctcatgatccacaagtctcggcctcccaaagtgttgggattacaggcgtgagccaccgtgcccggcctacaaatgttaccattaactcctccttctgctaagaaataaaccaaaataaaattattcacaaatataactgttttgatcatgctttcagatgatatgtaaagtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccactgtgataatttactacataaaagtacaagttacattatataaaaagaatggcctggctcagtggctcacgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttgaacctgggagatggaggttgcagtgaactgagatcatgccactgcactccagcctgggcaacaagagcggaaactccgtccccccaaaaaaaatgacaccaagaaactgaggtttctagatgagggttacacaatgtggatctaaaagcaacagggaaaggaaaaggatttgggcctagaatgtggggaattttagatgctgcagaaagccttctggtgtctttctagaatggctggattttggttaaggcaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcgcaaaatccagcattagcaaagaacactgccaagtttaccaaagaacccctcattctcaatatctgatcaggttcttcattcttcaccattctgcaggtgatgtctgatcaccctggccagtcttcagcaagaattctttcagggcggtttagccagaatctcccttactcctgatgtttcctcttagtgattttccattcactgacccctgcattgctcctgggctataaattcccacttccccatgctgtattcagagttaagcccatctctctccccagctccaagactgtgttgcagtggttcctatatctatggtgatggtcttgaataaagtcttctttactgtgcatttgaagtatcactgaataattttttatttaacaactatggtgttgaaactcaactaggacagattcatcactggatcctgggcctctcactcagaaccctaaatgcatgcctttgaagtctttgttgtcatttctgactgattagggatccgttggtgaatcagattcctgagccattgttccagacaaaagcccgttgatggctaaggacagattttgaatctgaagggatgaatattctctctgaagctggagtagagtcgcaggcttcttttgaaagcaatcctctgggcaggaaggtcttcgtgtgggcttcttgttctgagtggtctattctctgagtccctaggctagaagtctcttctttctggctctctttttctgagtgaggggttattccctgattccctgggctacaaattgttcttcctggctctctataaaaccactctgctctttctcttctctctattggatcctgcttctcccatgggagctctgtcacctgaaacccctcttctcaagtctctgctgactatttccatagctggtagtcacgacgaggagacaactgtgtagggtcaatatctgggccaaccatcctgaggaactgtgaggtttagaactggaaattgtcaagagaatccgaacccagctaccatataagagagttcaacttatgttcaatgtgaatgccatggcaatattaaaaggtaagaattcgatccatacgtacttgaggtaaataggagaaacctagaatttatgtaaacagtgagaagattggatgcgttttccgtctcatattttaatactggcagcatattatatatgtcaaaccatcaggcattcagaaatacatgcttatgaaaattttttgcaccatcagacaaaagacaagggtagaagacatttgtaaccctataaacactagtaaattaaaaacagaaggaccttaatgtcctaacatacctgtgttgtgaaaggctgccctgtgaaataccggatttcttaaacatattttaaaaatcataggcgtcaatattttttagatatccttttaaattttctcgttattttacaatgcctatttatttatttagtggctctgctgattttgatgtatatccaaaactttatattttctttaaaagatgttttatacaactttatgtaaaatgtttctgtatcttcacattctctccctgtccttttgttttgctcttatatggtggtcctgagtcttttctctggcttttcaaacctagtaagactatgacactaaagtaactttgcccgtggtttgataatgccttctaaagcacatcctaagctctcgtgcatacaggggtctcctttgagctctgtgcttttgagatcccatacacctaaattccagtactccaaatcagtactgctcagttttagtgactaagtttaaaaatgtattttaatagcaagttagtttagtgccctcttgcttctttcttgactgcttgtatacatgtatattcctttaaatgaatcttggaatttatttaaaaatattaaattatactaatgaaactgtataatgttgtgaattcataagtgaatttggaaagaatttgtctttatgatgctaaatcctttttatccaagaatcatatgtgtctttatatttattccagtctatatttatatcactgagtaaatacatagaaatgtggataaatacagctgtagttacagatacaaatatagatatagcctgttaaatctatatctatcccatataacatatatacatgttatatgtgtgtgtttatatatatatgtttatgtcattaaagagctcccttaatatttttcttttatttcccataaaatttaggtcgagcttgaattttgcttgtataaacaagtaaaaatttatactagttttaatactgatgtttagacattgtatcttattttagtgctgaatattttcacaattattataaatatcatctaataataataatgtacctgataaaaatatttaaaattttacctttgaattattttattgttgaattaaaattcctttaatatgatagtcaatttctgttttatgctttctctatgcatatgcaaattaatgtatccacttctctgtctctatgtagtaacatatgaaaatcaggcctctcttcttctaatggacatacacatgtttgcatatagaatatcagaccctttatagcatttaaaacctttaaagacatgaatattgccttttaacaaacatattttagcatgtactgagaatcccctatttatttttaatttgggctaatcaatacgattattaatattactggattaccaaatttggaaacacactttcatcccgaaggtggatatttgttttttttttttttttgccaatttcttgtcttactgtttcaaatattgttggatattatttgtattttatttggcattttagtatcaacatttgtaattgaggtactctacatattttttcatcaatatctggtgggtttcatagttactgctatattggatttgtagtagacattgacaaaaattattcctgtatgttttatagctgtatgaaggaaactaatatattttacccctaaatatatttccttgatatatttcaaaatggctattgagaagggctggaaaagcaatgttagctgcaaagctgtcttggggagatttgcatcggtagagaatctgccctgatgcagccaggttttctctgaggtctgcccccttgtctggatctaggaaaggttaactgagaggctaagtctccaaaggtctgaaagaaacattttctttctattctctctgaggactactcccagtgaggttccacctatataataagtccactgttgctagccagggtcgttttctcacataacctttttctttcttttccctgtgatccaagaccccatttttctgtaaacttcatgtggtagataagcttctgcacgcatcgtgtgactgggtcttcgttctaagggttccagtgtacacacattacagaaacctgcatgccttttctactctttatctgcctcctattagtgattttcagggagacttcagaagacaaaagggacattctcctttagcctattctcagaccaattcccccaacatttaactgattcctaatagcttaaaatcactttgaaaaatccatatatttatatccttttcttccctctatgatttctggtcagcttgggttttgtttttcattccatttacttcatcctcgaaaagatctattttacgtctatttattctcatttatggacattgagaaaagaaaataactttcatgtgagaaatgcaagtcctttgaaataatcaggcccagagagatattcaaatgacacagcagttctgtcctgctcctctttgagctgtgtgttcatctaggctgcttgctgttgccacagtagctataaattaaccaataaggccacaccagacactataatccacaccccataatagtgtaacagtgtgtagccagtcactaataaatgttatttccataagccaatgagaatttgtgacaaacctctttgcgtcatcacacttctggacccttttttgcctttaagtaacttcttgttgcaaagctccaaagggagttcacatccaaggatatttgggtctgtttcttccaggcagctgtcctcactgtggctcaagtaaactctttgaattacattttgtgcttcagctccttccacttagattaacaacatggatttgtgtcaccatgtacagcaattaaaatgtttacacttttcccctcgagagcactgatgtgttttcctgagcacttggaatagctacgtagtgtttcctgtctagattatggtttctcaaccttggtgctacttacctttaggaccagaggattctttgttgtgggaggctgccctagcaatgataggtgtttcgtttgacctctaaatttcacacctccaccagtcttgacatccccacgataaccctagacattgacaaatgtctcctggggaaaactctccaccagttgacaggtaaagttctggaaatattggatttgtcaattgagattttatgttatccaaaacaaatatttttctttgttcttaaacatctacttccatctacttatctacttatttttacttttatttgtaacttaattccatcaaggagagagagtgcattttctgttatgctaaatttttgaagaatgtattgatattttatgacctgatatatggatgatatgtagatattacatgtttgtattatcaaatttcagggtgataataaaataaatacttataatatttatattgtcactgtatattagttattttctttcttcactacaggagtttttcaacctataggctatgtttcaattctaggttatccagtagattttgaaatgttatgattaaatatctacttctcaagcattcatctttgcaaatgaaacaatcctaagctcttataatacacatcatataaagggcagactagtcaatgtatggttcagaaataattaagtaatatttataagaaaattaaaaatttatatccttaactcagataacaataatccaaattaaaatttgatttcattacataatttaaaatgacatcagaatgctagtaaaaattatacaaaaaatttatgtaatcttattaagctgtgggactttattagcataaattcaaatacaggaaccaaagtaagattgagacctatagtcaaaggttaaaatgtacacattataggggcatgattaaactaatttaaagcataataacatggagaaatattgcaaaacatacattttactgaattaattgttagtatctaatcattttgtgagaaccaaattaaaaagtagctacacacgcacacacccacacacaagtgcaatactgtcaaataaacgatgttcagctacactagaaatcacacctgtgttttctccacagaaaagattaaaaatcgcaataatttttattgtacatatggaggtaaagatactcaaaatattaccctaaaatacattatttttttgagatggagttttgtttttattgcctaggctagagtgcaatggcacaatcttggctcactgcaacttcagcctcccagggtcaggtaattctcctagctcggcctcccaagtagctgagattacaggcatgcaccaccacactcggctaattttttgtatttagtagagacggcgtttcaccatgttggtcaggctggtctccaactcctgacttcaggtgatctacccacttcagcctcccaaagtgctgggattacaggcatgcgcctggccagctttttgacatatttcacgatggctactcggaagactggagatagcttcttctacaagaatagctgaaaagctgtgtttgttggggagatttgcatttgtagagaaaatctgcattgatatagacaggctttccctgagatactcccttgtctgggtataggaatgattaactgagcctggcacgtttacatttctaaaagccatttcctatctatacttcccaagaggagggctgctccctgtgaggtttcatccatgtaacaagaccacctctgctgccaggctcctctttcttccttgtcgtcacctgtcttccacaaagcctgatttaccaacctacagctctgtgttttctgcaacctcaagacagcataggcgtgttgactaccttgcctttcctggagtttttatataaagagtatatatttgtatatctctttataatatacaaatatttgtatagatatatttatatatattatgtaaactccaagtgcatacttgtgcacatatctgtaaacctttttttcctgttaatttgtacattatcagtttgttttatagactcaaataattaaagcttcaagggaaaaatttaaattttcctatagagaaaagacaaatatataggtgacaaataatatttagagtgtaagacgctttttaaaggtatatttgcaatttgtgtcaaaacattgaaatgtacatttgttattttaacaataaaatttcaattaatttaagccaaatacatagtatatgcagaaaatttagcaatatatctatgtagcaccttactgtgcattattgtaaccagccgtctaatataaagaattaaggtagcagctgctttccaaatagcgcatttttttcacagacctattaaataagacaaataacatttaaactttatttttaaatttgcagaatagcagttttcagcagatggtttattttagcaaattccatcttcacattgtgctatgcttttatgagttccagctgttaacggatactattttactgctgaaactatcctgtgtgatataattgctcattatgtgccttaaaacacaagcaatataattattttcaacttggagcaaattaaaatcttatcagcaatttaaaatctctagagtcatcttcttctggttaattattttaaacttgtatttttctctttatgtttttagtgagttctcttatcaaggagaagatctcaaggtgattattcttttttttctcttccatgcacctcgcaggtgtgttaataatttcatttctcagaaaatattctttcatatctatcttacaagatgagagaccttttaatatcttccattcggatgtgataccagtaatggaacatattccagcttcatgaatatggtgatacaaatagttattcatctaacctctttcagtgccaaatgtttactatactcagtgagttactcagttgactggtaatttcttctgaaatcactaatgagaggatcagaggtctggctgttgtctgtacctcatatgactcccagtgcagacaatggtttctatggagcacagacagttgaaaggattgacttcctgcctagaatagtttctgctgtgcttcttatccttcttgtggagatttcagattacctgaattgcttttctatcttaagaaaaaacgcaacaattctcccacctgagaggaatgtaaactgaagtaagttaacagaaccaatccataaagtttttacattgtttgttgcaaaatgcagcgctggtgtctccatcactaaccttttctatccctcattgctctttctttgactgcaataggatacctctatgcaaatctgtattcccgagactgagtgcccttttggtgagctataagcacactcaatggtaggctgaaatactagtttttatctatggcgaaatggaatcatatcagtgaattttttaaaaaggaaatttaactcttgctatggtttgaatgcttgccccttccaatctcatgttaaaatttgatccccaatgttgcaggtggggctcactgggaggtgtttggtcatgggtttggaccttcatgaatggataaaactctcccttagaaatctaaagctatcctccctcctcggtgccctcaggaatgagtgtaccattccttattcacctatgattaccccacccatcctttttgagatattgactacatgtatgttacactgatgcacattgtctgacctatgagtgagtttctggttttcttattttagtttaccgtttgtcctttagtttgtaatgcttccaatttgttctataaatgttctgatgttagggtaaaatccattacttattctatctcatggaatttttatttcaagtatttatttttcatctatatatgtcacatttttcattttataacttttatttttctcctatatttaattttcatttaagtaccttgacatatatatgtatttatctatatgtatttataaaatatatttactttaaggatcttgaaatttccttcttttctgtcatttataaatgacttatttttatcctgttaatatatattttaattatatatgtcttacagcttctttgcatttcagagtttttttttgggtattttgatgttatgctattgaatatctagattttattggctacctttgaataatgttgtgacaggcagttcagtaacttcaggatgagtatttgtctgttgttttaaatcttctctttaaactttgttgagttagtctagagccatctgtaatttggagctaaatgagcactgtcactagggcatgaacctccagtggtctttactgaatatcctggaggtacagaggggattcccttctctgattagaatttggaatataaagagaaaagagaaaaatagaaagctatgcataaacacgtgcattaaaatgaattttatgtgggctttttcatgaaaatgttcctaaggtattttattttttttattgtggtaaaatgcacataacataaaatgtaatctgttaaccattttaagtgtacagttcagtggtactaaatatagtcataacattgtgcagccgtccctaccatccatctccataattcgtttcatcttgtaaaactgaaactctatacccattaaacaatacttccccatttcctccttcccccagcttctggcaaccatcatcgtaccatctctataatgctaatcaagcatagtggctgtgtttcttgcttcctctagtccgcaggtagcatacaaatgtaataaactacttattcatgtcgcatctatttattttctgccttataccaagcttgtgggattctcttaaatacaacatttttatacttacacctatgcaatacccattagcatcgccttcctaaatcaggggaaattgagcttctgtcaggtggagtaacttcctaagatataaaactcagcattgaagtctgtatacttcaatatcctgccctcttctcatgtgtctttactgccttttatgtatgtgttagatgttcaacaaattctcttttttaaactgaatttaagccgtggagcagtgttttgttgaacaataaatatgatataggacactcttcctccttttcatgtatgatcctgttcatgaaaaagagaaattctttcattgtgctagaagcttaaaataatgaaaatgccactttctacattaaacagaaactgaagggaatcaaggtgaattgcatgagacatagaaaacaagtgggaaagaaatctagtataatttgccctttgtgtacctttattatttagcgtttgagtaaatgattcccccaaatatcttcccatctcaattcatgtctataaagtagacgtttatgtctcaccttgtcaagaagggcaaagtctaacataaacatttcccaaaaatgcttcctgctaaaacgtaagctcagtctggctagaaatgcagctcacttcctaaagattaattggtagctaattttgcatgctgttctctgaacttgagtgtaacctgtccgtcaggcatacagggaatgacgggaaaggtgacaacagaagatgaatgctatgtcactaaccttcaaagatgacctgccttttctttcaaattcttgatatcttaagacttcattaattcatctctcttttcccttggttcaacattttgctataccaaaactcatgtgagacaatgacctaatgtaataaaaatggcatttttctttcatgtagttgcaagctaactggcatttttacaatccacatatttcctttgtcaatttttcattctgtattggaagtaattgatgggtatttctgaagggatgaaggtgtttctgtgttcattgtgatccaaactatttctagacctaggggcctttgtaaacaatttgtgcccactgaccaaggatcactgtggcagaaagcagcaaacttgcataagatgtcactgcttcataggttggctttgaaaactaggggcttactctatactcttatgaataaaagacattgatagatgtagtataagattacaatcatattttccttttgacagtcacattataaatcaagatgtattgcaattaatctcaattagctgatcacaattaaaattaataatgtttattattgctgataaaaatcatgtctctcctgttctcaaatgtgcaagtaattcttgtaattttaatacaaatttgcatattattattaattgatttaatctcattggatttggttcatggatccaatttattaaaatattgataatgggataatgagttgtctccccatttcatgtacactaaaaacaacatttcttacaatggtctgcaagcccatcatcatctgcctcatgttaaccgccaaaattcttttatatcttcacccttgatcttaccagtggtcctggccacctcactgtcctctggacataccaacatgctgctgccttacgatcaagactctagttaattttttggcttggaaagatagccctccatatatccattgatcagctcattcaacttcctcaggtctttactgaaacttcacattctcgatgaggcctattcagtatttcaaactgcatcccagctgcaacattccaaaaccccttactcttctgtgtatttttgaaaggatttattgagatataatttacatagtgtagagtgcacacattaatgtctacaagtcagtggcttttagtatatgtacagataagtggagccaccatcacaatgaattttagagcattttcatcacttcaaaaagaaaccccaccttccctagctgttaacctcctatgcacccatcccctactcaatcctaagcaaccacaaatctgttttctgtctctatagattttcctattctgttttcatctaaatagaatcgtacaataggtggccttttctgcccggcttcgttcagttggcataatgctatcaaggttcatgtacgtattggtactttatttctttttataactgtataacattcaatttcatggatataaccttttgtttatccaatagtatttttattgacatttgagttgtgttcagcctttggctattttaggtactgctgctaaaaatacttgtgtacaatttgtgtttgaacacctctttccaataatctgggtgtatacctaggaataaatttctgggtcatatgacaattctatgtttcatatatttagaagccatcaaattattttccaatgtggccagttctagccatagagtatctaactgtggttttgatttgtagttgcctgaagagtgatgctgttgagtatatttttatgggattattgaccgttcatgtatcttcttgggaaacacatctattcctatcatttatcagttttgagttgggatatttgtgacggagttaaaccaatttttctatattcaagatacatatatatatacagacatatagatacgtgtttttcaaatatcttctcacaattttggagctgccttttgacttgcttggttgtcctctgaaacaccgatgtctttaatttttaagaaattttaaatatctaatttttattctgttgctcatgtttttggggttacagctatttctttgctagatccaaaatcctgaagattttcccatatgctttattctacctcttgcatgtgtgtctttaattcatttgagttaatatttttgtatgctttggggtaagggttctaatttattattttgcaagtggtgatccacgtgtacgttgttgacccagtgtgttcaaagactgtctcttcctcattgaattgcacatggcaccactttaagaatccattgactgtagacacatagttttatatatggactctcaattctcttccatcaatctatatatttttccttcatcaatgttgtgttgtcttgattactgatactttgcagtaaggtttggagcatggggtgtgaattatcctaatatgttttctttcttcaagattattttggctattttgagtcccttacaatttcatgtgtattttagaatcagcttgtcagtttctagacacaagtctgttgggatacttgcagggatttcatcaaatctgtagttcaaattgtaaagtactacaatatcaaatcgtccaattcatgggtgtaaggtgtttactaattatttaaatattctttaaacaataatttttaattttcagagtaaaatcttgtatcacattttccaaattaattaatatttctttttttatgctattttaaattgaagtgttttcttaaattcattttggggttttcattgcagatgtgtgcaattgatttttgtacatttaccttgtctgctgtaatattgctgaaataatttacgagttctatcgttcggtggattccttaaaattttctatatacaacaatgttattttcaaataaagttttatttcttcctgttcaatatgggtgactcttgttattttagttgccgatttgccctgcataaaatctttagtacagtgttgactagaagaggtcaaagtatatatcctattcttatctctgaccatagcgggaaagcatcctttaccattaagttgcctgcttgctgttggcttttcacaggtgccatgtatctggtgtagaaagttctctattcctggttcattgagtttttatttttatttttaatcattaaagcttttggattctgttaaatgtgttttccgaatctatcgagatgatcatgaattctcttttcttattctatggataagatgtattaccttaatggattttgggctgttaaaccaacctgggattacttgtataaatttcactttgtcatagtgtataattcttttatatgttgctagatctgatttgttagtattttttaaggaattttgcatttatacttatagtagttttatttttctatgctatttggactaatttttgtatcaaagtaacactggccccacagaataaattggaaagtgaatatttctcttttttaaaaaagctagtcaagaattaatatcaattattcaacactaacaaatattattattataaattattaatttctctaattttaattttcttccttctgcttgctttaggtttagtttgctattcgttccagtgccttaatgtggaacgtcatcttatctcatcctttcatttgtcttttcattttgtaaatagtgtcttgttagcatcaggtgagctccccaggttggtagtactccatgtttgttgctgtacaacaatgacaggtaatatgtcctgaagacaatggaaacttaaccttcaaaatctcctagattccaccttatatgatatgtctcttctattggtcctaatttctaccctttctctattataaaccatgagtacaatggcattcaatgagttctgtgagtctttctagtaaattcttgaaactgagggtgttcaggggaaacccctgaactggcagttggtgtcagaagtgagaatcttcttacatggcctcttcctttgaactgtgcagctggacgcaaactctgcacaatttgggccagaactctcgtgttgactttgtagcctaaagtatcttgtagtttgtctaaccctcaataaatttgctttcatcaaatattgtatttgttaccccaaaattaccatcacgtttttttttctccaaataactaacataggagaaatagccagctgagtttgtaactcgacagaaataagtgatccatataccatataccatataagtggccatttcattttgccttcttccaccaaatcttagcaacctcaaccattaccaagagccactgtaggcctaccagctacaaacaaacgagtatcttgtaaaaacacttcatactcccatttgataattttcccagcaaagagatgcctactttaactctatgcaagtggctcatattcacgaagtctgtagatattattcatgtagagtgagaaaatcatcccagcggtgccagcacattctccttcctatgatctgcttagtttgcaaacatattcaggccatgggtgagagatttgtatttcacagtacaacaattttatggagggcattgaaacttacattgagcattttagtacagtcacacatcactgaatgatagggatacgttttaacagatgtattcataggcaattttaccattttgcaaacatcacagagagtattacaaacacctagattgtacagcctaccacgtttaggttatatggtatagcctctttctcccaggctacaaatctgtgtactacattactgtactgaatactgcaggcaataagaacacagtggtaagaggttatgtatctaaacataattaaacgtagaaaagtatgtaaaaatatctattataatctcatgggaccacttttgtatatgtaatccatctttgactaaaatgttattatgcatgacatgactctatgacaaaaataaaataacacattgtaaaaaaatatacacaggtatcaaacatattaatattgtaaaaataaaaatatttattcagtgtaagaatttgtaatgatcacaaaatgttcacagcttatattttagtacagtttcaaatgcctagtgcaattgctatttatttctgtgtgtattttaaacatgtatataataaatatttttcaggttcaacaatatatatcaatccaactggctcttataaatattagttaacatcaattggtaaattcatatatatatatacacacacgtgactcagtctgtatgcgtgtatgtgtgtgtaaatgtaactgtatgtgtgtgtaaatgtaactggatgcatcctaatatttacccttacctacaagatttccaagactcatttattctctttaaatggtgtgccttgaaagatttaccaaataaaaccgcaatcgtggaatatatcaagatgttattaaattcatcttgtgcacataattgtttctttaaatttatgtttcttgcaaaacttgcggtaatgctcatgcacaaaataattttctaaataaaaaataaaaacattttctcagtcattaattcttaaaaagtatttctccccagtaattaatgcgaattcattcttaattcttaattatagaataatgttgcccttcagagttctgaatcttttgcacgttgtatacatttcactgactggaacatcttctggaatattggcattaattaatctcactcagcaattaatgatttcaaagaaattaaataccattcatattctgaatcacaagggtactttggcacctaatttaatcaagctctttgtatcatcatctacagtttaattacttaacaaacatttctttgtgtgagaaagattgagcaggttattgtgcttttcgttgtatacatttcactaagtagaacatcttctggaatattggcattaattaatctcactcagcaattaatgatttcaaagaaattaaataccattcatattctgaatcacaagggtactttggcatctaatttaatcaagctctttgtatcatcatctacactttaattacttaacaaacatttctctgtgtgagaaagattgagcaggttattgtgcttttttatgatgcaacttttgcttaatctagagataggcaatgctccctataagggacaaagagaaaaatgaaagagcaatagagatgtgacaggcatggaaaaagacaatacatttataaaacaaatagggccacagatgatgataatggggatcaaatcttgagatactgactcagtttataaccgcactgtacaatagagcaaatcatttgttaattattttacaaatggaatctaatttaactaagatgaatacagtgttttaaacaaggcaggtcatcttaaaataaaatagtgggaaaagtgataaaaccaatgtaaaaatcataaacattttataaagaatttttgtcatgtaatttaatatttttctttatttaaaatcacccaaatcaaaataattttatcttaattaacaaataatcatcagaagttaactaatttttactttataatactaggtttaaaaattcttcactatatttttaatcatacatgcttatacataaaatagacatagggtatatgtttacatgttcacaatattatattgtaattgttcctatggatgtggtttttcaatagaattaataagtacttttaaaaagtttcaatttcaatgatatatatgtttgatttttctttgacaaagcatacatatattgataggtaataataagaaaatcttctaaagacattacaggaacatgaataagtaattaaatcctcaataatttgtaacgttttatgtaagcggaacacatttaactgaaaattgcttttatataatactcaaacgagactaaaaacatattaactagcggagtaagtcttcaaattgataatctgaactatagaagaggagaaacttcaagcactcaaatatttgaaatgctacaaaatatttatataaactattatttaacaatttctgtttgtagagtgctatagagtaatccatataaatgacatctcagtctttctatagctttgaccacatttacctcctaattttaattattaatatgttggagcagtgcatacaactagattccgatcttcctttttaatgagtaaaaatatgtcctttgagacagcattaaagaaagagcaccttgtataaattcaatgccaagagacaagatattcttgatgctgaagtcttgttcttttatacagcaatgtaattaataagaagaagaaaagcaggacatagagatggagtctattttcatcaaaaattgtctatagattttgatgataaaatttaaaactctactatatttagttagtcacaaaaaactaggttgtgggaacatatttggtcaataaaacacccctaccaaatgccgacaagaaaaaaagttaggtaccacctttcttctctgcagatggcctgagatgggttaatttgaaagaatgcttccaaacctgaggtgacccctgagaacagcataatccactgctgtctcccacattcagtttctcagtctgtgctcttttaattttggggggagggaagccagtcctttaaagcgatcttcagcatgatggcagagccaaggagtgtggacaggtggcacggtgtctgattttgttccagcagccacttgggctttctctgggtcttctctgccctcgggatagcactactattgaaaacatgtctttgtgacattctctatgccaggaactcccaacatattttccttgaaactgatgaaatgaaaaaaaataaaccaagaggtgtgctgtttgtttctgtttcctcctttctgcagcccttcttgatcatctaatatttttaaatacattgtcgatcaccaaaaggagcataagggctttattggtttgtagcagatgtattcatagcccagcccctattccttagctgtagctgctgggaagaaaaccattcttaacactctacaaggtctcatctccagaatttgcaccagtttctagctgaggactttctctagcagcacgggagcttgttactgggcatgaagtgggaagaaaaggtgagggtaactaagaagaatctccctggattcagtgatgtaattctgaggcatgctccacatagcttcccataaaattaagcccagatatctaacacaggaacttacctcttaacacgtgtggtattggcttttctgtctttcctgttttattttgttctcttttccttgtctcactttcgctgtgtcctcactcctgctttaagaatacccaaacaaatacgttcatttatttttttagactctcagaacacagttgatagttgaacttgtaatctatgataatcagcttggttgctgtattgacaggaagatggtgaactcacaatgtctaattaagatacaatttaaaaaatatattgtatcatgtccaaagacttaaaaagcctaagcggcagcgtcacagtttcttctttttagtttgcatggtttcttaaatgcctacaattattttaaaggaagccttgagtctaggaaaaattgagacatatggaataaattactaacccatttctccttgaaatccattagatgtttgatgattcttcacatatatttctgaactgaaaagctagttgggaattatttttataagcatatccttatgtaatatattgtttctaagagtgaatggaaggtttaaagattaaattattctatccagagaataaaaaacaattatttcacaaggagaacatgtgtatgttgacacgacattttaaaatctagattttaaaataggtcccatataattttgagtcaattagaatacgtttgtatcagtctgtctacagttttacacctgtcaaatgttacttgaactaaaagaagtaccttgaacaattttgaaatttattattcctctgaaactgatgaaaagaatgacggtagagtgaaatttggattggcataatttaggagagaaattattccttggagatcaacctctgccaagatagtttacaatgacattgatactttttgatttacacaatttgttatataaaaaatactaagacgatgacagataatacacagactttaattaaaattgtactaaaattaaaagtctaaataaattacaagtgtacgtggtacatctaaacgtatgtttatatattttatttgtgcattttattcctagggttccttttgctttagtttgtaaaacgttcttatttttatggcagtgtagtatatactaaataaagaaaaatcaggaaatagaaaatgaagaagaaaacattagctattgtcaaccaaataaaaattgtgcaatctctaagtacatgaacgatgtattatttgtacagcatgtacaatgtttatgcttcacagggtgaggtagagactgcaaaacattgaacctgggacaaataagaaagaaaggaaattttcacaatatattaatattacagaaaatgttgaacttaacagttaagatacaagtagtgaaaaatgatagtatttaaggagatctagaaaatgtcatccataccagtaatgtgtgagaagtattagaataatgcttgtatttctggattggcatcgatttctattgagactggaaacatactagaagtgagcaaaaaagaatttaaatagtggatacttgagttttatacctaggagttcgagaaatacattttgttactatcaaagcagttggcacaagagtgtacaacattccctaattgtgtctatgtggtgaagacatagacaaacagaaaatagcaaaacagaaatagcaaaaaagcacaaataaattttacctgtatttttacgtaaaagccaattagagtaggaaaacatgaaatttgtgttttatcgaaatttttctcttatagtatagttgattatattactggaaaaaaattgaagcattggtatgttcacaaaaaaaagtaaaagataaggtcaaaaccatgggaatgcagggagcagacaaaatacacctaaacactgatactgattttgccctacggacatgtagcaaaatgaatgagtgcagattcctatggtcatacatcacataggacagtaaagaaatacatagtgtttcccaagatagggcatcacacaggagctcttccctaaagctagcaccaaaatttatctcctcagtataaagaagaatcagaggtaaattagtctcatttcacattccctggaaatggcaaataaaaatgacttgagattggacagatttaaagaaactcaatcattaatgatttacagcaattaatttaaaaattgtttaaatgtgctgtccaaacatacgtccaaacacctttaggccaagaattaatataatgtggtcccagaatggtggtgcctttagtagactcacaaaaaattcaaattctctttggcaaattttcttcttactaatatgcaaaagtgcacaataataattttcagagaaaaataaatctttgtcattcaaaggcatctaagtacgcaaggaaatgatattccaccatttgaaaggaaagcagaaaaagagtacaaacagatccacagagtttcattagtagaaatatcactgttagattataaagcacatttgctttcaaaaaatttaaaaaaaggaatatatttttaggagactaaaaagttgatgtagtaaatttgaaaagtagtttgtatgtagtattttaaattaaaaactcaaaaatgaactcatcagattagacatggccatggtgagagctcataaatatttcagaatgcattacagaaaatttaaaaaaaggcacaatgtggacagaatcatgaagagacatggaagatacagtaagaaagtgtagcatgtgtttagtgagtgttctcatagaggaagggaacggggaagggacaatatgtgatggtattttggctgaaagttctctagagttttgtaagacactaatccacatattcaaaacttctatgcatgctaagcaagctacgatggagataaacctacatctacatatctcctagagaaatagtaaacaatcaggaagggaaaaatatttcaattagcactagaaaaatcaaattacctttaatcatattgaaatctgaaagcatgaaaggtaaaataaacaatattatttgttaagaataataatgccattctgaaatcctcaaccaagaaaaatattcatcaacctatggctaaatcacatatttagagacaaaaaacaaaacaccaccagcagaattccactaaagaaactcaaaggaaactctgaaaacacgcttcagaaagattgaagttctgaaatcaaagaatgaacacagagcaaaatatattgtaaacataaagatagatcaaaatagaaaattaggtgttgaaacaaaagaatatttaaaattagataagcactgcaatatgtatgttaggaagcaaattattagggctgaagtattcaaagaccccttaattgtctgacaagagcagaaaggtatgactttgcaactcttttttttttttttttttttgagaaggagtctcattcaccctttctcccaggctggagtatggtggcgtcatctccgctcactgcaacctctgcctcccaggttcaagcaattctcctgcctcagcctcctgagtagcggggattacagccgcgtgccaccctgcctggctaatttttgtattttagtagagacggggtttcaccatgttgatcaggctagtctccaactcctgacctcgtgatccacacgcctcggcctcccgaagtgttgagattacaggcgtgagccactgcgcgcgaccgactttggaactttaataaattgactggacattatgcatttctctgttgtatctatgaaaacaataaaaataaaagtcataattttaaaacaagaagacagaaagtgataggagaaaatgagacattttatatatatatatatatatatatatatacacaacaaattactaatacaaaattaagtataaatgatcaaagattaacttaaacctaagtagacaatgtttttgttaaaatacaaagattggcaaaatttaaaacatccgtctctatcatagttacaagagacacaactaatatataaatttacagaaactttgaagttcaaacaatacagatactgtgtatatatgatatacatacaaacatactacatgaatataattttttaaaaagttgctatgtagaccaaatagaatgtaagttagaaacatttattaaaataagttagtgtaaccagtgtgataaaagttttaagttattaagaagatgtgatgacttaaatgtgtattagcctgatacatacatatatatatacacacaaaccacacactctctcacacacacatacacacacgtatttagagagagagtcaaattatataaagcaaaaatatcagaaagtaagtagaaatggataagcccccaaatattatagacatttcaaacacacgtctttcagtaatagataaaagaaaaaattaaaagagtaagttttaaaagaagctagtggattttaaaacgggcaaatattatataaggaacttgaatattataattcatgttattttcatgttcatacagaatacttacaaaaattaacattttctagaccataccacaaattcaaacaattttcacggaaataacgtgacacagaatatacgtcctaaacaaacagcaatgaaggcagatatcaatacaaaaacgaaagttagaaacataagtgtaataatattggttggaagccattttattgaatattgaaatattttaaaggtgaatagtcactacaaataaaccaaacacttttgtgaggccactaagatacatgtgtaatgtgtaatgcctccttttataaggagtaaatctgtaaaatcacctgggctatttgacaactgcaaagtgaatgtgagaaggagagaaacagtgagagagagagagataaaagcagtaaaataaacataaagaatgaaggagatagccaggcgccattgttcacgcctgtaatcccagcactttgggaggccgaggcaggtgggtcacctgaggtcaggagttcgagaccagcctggtctaacatggtgaaacccactctctactaaatatacaaaaattagcctggcatggtggcatgcatctgtaaccccagctactcgggaggctgaggtgggagaattgcttgaacgtggggggtggaagttgcagtgagtagagatcacgcgactgcactccagcttgggcgacagagcaagactccgtgtcagaaaaaaaaacccaaaaaacaagaaagaaaaaaacgaggaaatagtacacgaaaaagcagaattaaagcaactgggtatatatttaaaaatgcaaaagctcactttttcagaaaaatattaaaatattaaatctaacaaatatctaggtagactgatggagaaaaatacagaaaatgcacaaaaaagcaattacctggaatgcgaacgttacaaaacgtcagcagttgtagattttaaataaacaatgatttttgagttcaaccatgatggggcatattgaaaagaatctctcagaaaaaaagaaaaagaaaactgttataaagctatgtacaaaatgttaagcactattaaagtcttccaaatctaccagttacggagttattggtcttggactaacactcctgaaaagaaaaaaaacaaacaaaataagacaatacctaaaaacctggataaaatggcctaccgtgggcaccggcaatgcatccaagcaggtaggacctgggtgctacattctctttgtcagaacacaaagcattcatacactcttctcaccctcactttcaccttttaatctttgatctactattaaatgtattcaacattactatcaatcctttgctcaaaatttctttactcacattttgcttgatgcacttggatagactgttcaagaaagtgtgagtagtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcactacctatttccagaattactctacagctatgaaaatcaagattatgtgttttgttgaaaaaaaaaatggaatatatatcagtggaagagagaatccagaaatagatactcacatgtatgtctaattgattcttaggacatatatatatgtatacacacacacacacaaacgtgtgtgtgtgtgtgtgtgtgtgtatatatatatatatattcaccgttttgaagattatcatctccaaatagggaatatatatatatatatatatacatatacagacacacacaaacacacacacacacatacatattgcagtctgataagataaacagcacattgaaacaatttctcaaaagacttgaatagatacttcagaaaagaagatacatgaatggtcagttagcataggaaaagatgctccacggtttagtcatcagggagatcaatcagtgcaacaatgagataccagtacatatccataagaatggctaaaattaaaaaggctgaaaatagcacctgttggtgaggatataaagcacttggaagtcttatacttgtaggaatgaaaaatggtatggctcctttgaaaatctaacagtttcttaaaggttaaacataacacaaatcagatagacagtcattcccttcctaggaatttacacactgtgtctgcacaatgatctgtatgtgtgtttccagaccaacctgaggggcgggctgctatttctcgtggctcagtaacaagacacagatgaactggggaggaagagagttttgacttctgcaactggttacagggaaacggcctggaaattatcaccagaccaactcaaaattggaaagttttcctgggctaatgtaccttctaagctatatgtgtatgtggaagtgtgcattcatctaaatacataagtgattaacttcttttaatctataactaagtctgagtcctgaagaccttcctctggaacctcagttaaattcagttaatctaaatgggtctaggtgctgggggcccttatcttgtctcctgctaaatcacagaggtttggagagtcccttcagatctccaataaacttgtttgtggaggcctggggagtttcttcagacccccagtaaaacttatttaatactaaatggctcctgttaagaatgccttcgttatttcgtcatgctttaaggcccaggaaaaacctaggcaaaactcttggtgggcttttgttacattccagcctttgtataagggcactggcttcttttttttttttttcctcttaatatttaattgaaccactcagtcggtactgaaacagttgttacggaggcctgtgttagtgagacctggcctgccacgtatggatgctcatgatagtttcttcataatagcccaaacgcggaatgatagaaatgtccaataacaagtgaaagtacaaacatacatggtatagccacatgaaggaatactactcagtatttacaagacattacagatggattttaaaattacattgatgcatgaaagaaggcaacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaatagccagaatcattacatgcttaacaatacatgcaatgaagcaggtacaaggcccctaaaagcaattggtgagaaaaattaaagaaggctaaataaatatatatcatgttcattgattggaagactcaattttgttagcatattacatcaacacaattctgattaatatttctagtaggagattttagagaaatttgaaagctagtttcaaaatgtatttgaaaatcaaagaacctagaataagcaagtcggtcttgaagaagcaataagttggaggacttactctgctagatttcaaacctgattttaaagctacagtaattttaaaacagtagtaatggtgtaagtattcataaatatatcaaagtaaaagaatacagattcaaacaatatgcccacatatgtacagttattgatttttttttagtagaatcttttttattcataaaaaatccatcaaaacaaaaaagttttccagccacacacaggaggggtatgggtgggggaaggtgtctgtccatctatccctggcccccagcccatgtggttttggcagcaataaggtgtgtggggtaatgacccctgaaattaaaatggtgtgtgtatgtgaaggaaaggcgggcaaagctatggggagcggtggagtggaaggaacaaaggaggtcagtactgggaacgctgaaggtgggaggccatttcataacattacttgttgatgaaattgccatggataccttctttgcccatcagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaaggtgggtccttgttgccaacaatggccgtgtcctaacaggtcccgtccgccacgaggctgtagatggaggtgtccacctggccgttgcgttgctgcaggggctcctctggtcgctgctgttggggccgcctgggctggcgggtgggggaggcggagagcccgatgcaggtgctgtcctcctcgccacgactctgctagctgtgcagtagccctcgctccgccacttaaaaaagaaaaaaatatatatatataatatatatacacacgtgttatatatattgtataatatatatacatgtatacatgtatatatgtgtatatatatatacatggcacacgtgtatatatatataatatatacacgtgtatatatatatataatatatacacgtgtatatatatatataatatatacacgtgtatatatattaataatggcctacatctatattaataatatatattattaatatatatacacgtgtatatatattatatatatatacacgtgtatatatattatatatatatacacgtgtatatatattatatatatatacacgtgtatatatattatatatatatatacacgtgtatatatattatatatatatacacgtgtgccatgttggtttgctgcacccattaactcgtcacttacattaggtatatatcctaatgctatccctcccccagccctcaccccatgacaggccctggtgtgtgatgttccccgccctgtgtccaagtgttctcattgttcagttcccacccatgagtgagaacatgctcgcaccgccgcttctaaatgttttaaaaacaaagacaccaatgcccttcattggggaaatgaaagacttttaagtaaaacgattttgagtgaaataatatttgttgttttaaaaagttaatattaaccactctccatcatatattgaaattaacttaagatgtgaaagttaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggtgcggtggctcatgcctgtaatcccagcactttgggaggccgaggcggcagatcacgaggtcaggagatcgagaccatcctggctaacacagtgaaaccccgtctctactaaaaatacaaaaaaaaaaagaaaaagaaaaattagccgggcgtggtggcgggcgcctgtattcccaactacttgggagtctgaggcaggagaatagcgtgaacctgggaggcagagcttgcagtgagcctagatcgcgtcactgcactccagcctgggcgacagagtgagactctgtctcaaacaaaaaaaaaaaaaaaaaagtcaaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaagttaagaatttcagttacttacatccctcagtcctgattaaacctatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcaggtgggggtgggactagagttaaactgccatttattgatttctgacacaggcacagaatgacctgttttctccaagaggctcaatcatgttttcaagaatcctctctgtaccatataagatcctgcagacaaataacatctagtctgttgttctaaatgtctgagactagtgaacttttattcagttcaagtttctgtggaggcccaacaggcaaagctctgttctagtgactctgagggaaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgcctaggaggctgaggcaggagaatcctttgaacccaggaggctgaggttgcagtgagccaagattttgccattgcactccagcctgggcgacagggcaagactgttaaaaaaaaaaataataataatgataaataaaaataagaataaaaagcagagagtagcttggtgagagtgaagtcctgcttcctggggcacagagtcttgttgctaaagaggaagaaagatcgcatccgagaatgtgtggagatagcagtgcagtgtacagagcagggactgtgggcctgtctactgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtaaacactatctattagttgttcattctgctgtttctaaattaacacaaactttattagcatttgggcatatttccttcatggccttatggtgttatgtgtcactctttatgcttcagatatgattcttaaaatcataactgaagatatgatttaaaaatcaaagattttaaaaatctttcacatacttgtccttgaaattcccagtaaaagggaaaccatcagtcccatagtcctaggggccttcccgactgtacgagaaatcactacttcatgccccagtgcagtgttttagaggagaggctgcaaggcttgggaaagtggccccgcattcagagtcagacctcagggactgtgaattctgactccacttcgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggcgtgtctgtcttttctcagaatatgaagagtgcaaagatctcataaaatttatgctgaggaatgagcgacagttcaaggaggagaagcttgcagagcagctcaagcaagctgaggagctcaggtgaggggaccccatgggggcaggcaggggtcaggtgtgtaaatctctgaagtacagcagctcggtggggagatgtaagagctaagctgggccaggggaagggcaggaattgccatggcaggctcgctacacacaaatatttatcaaacagagaagaaggataataaaaatgtatgggttgcagttgtttctcagagccttgttttctctttttcaaacaagtaattgttgatgtgaaatttacataacacaaaattaaccaaaggagtgtgaaccacacagcagcattcagtatactcaaaatggtgtgccatcaccaccccacttacccttagtgagaatcacctcctgactgactgcggcttctcattctttcactcaatcaatgttgccttctcgaccctgtcattcttttcttctttcgtcttttcaattcgccccatctgcacctggcctcatttctgtacatggctttgtatctagtggccgcaagatgcactatgtgtattttcacatggaaatgtccatggccagagtgaggaactgaaaggatgtctttttgaaacggaattaggaagacacctacttttgtttacagaagagaaagatgaatggaacatcatcgaggatcttgcaggagccctctctgatacagaggaagcctgtaaaccattttctattctttctcttggccacagacattcctttaaacatgtgctgaccttctgcttcgaggtctccttgaggacattgtctcagaaatctctgttgcaatatttgagcggatcactcaaccctttccactcttaaattttctctaccgtctcaccttaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagagcggagatgggaaacccatggggttggaggtcacagtattgcaagtgtccctcctcccttgatggaaggtggtctttggagtatgaggcagcatctgtctagttttaaaggacaggaaggaggctgcgatgggagcaggcttgttagagtgaaaagagctctggactaagaatgaagattcccaggctgtcttttcggcaatgttcttagtaactgtcagagagtgaatgacttgtccttcctgaatttctctctctccgtggcagacaaattgtctcttgcaagggtctgaagcattcaaatgtgggaacacttacaactgctttccaaaatgagatgaaggccctcgccgtgtgatgttggagaaggcactttatgtgggggcgttttgtggtaggaagtgcttcagactggagcactccccatggatagaatgtccctgaataacacagcagaagccacttggaggcttgaaatcttctgatgcatagaggactgtgggacaagtttgtctgcttctaagagaaagaattaggtttgaaatgcaaactgtgacgggacaccaagcctgtgcctgggaatcagatctggcaggatgggggacacagctgccaatgtccagagagaggctgcacaagcctccagtgatatgggaagcaaaaggtcttttcaatatttggccacatcttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaatataacccagcttagacacagggtgcggcagctgtcatgtttctctgtgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaacaggattgcatgttccctcttaatgggaacgtccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccaggtagcctctgttttccttgtgtctcgtacctctctctaggctgaggaagataaactctgaagacaggctctatcaacacaaattcatttgaataaaaaactgtgatgggtttctaaacagatatcagggagtttttttgtccttctcagctaatgtcatgcctttgtctgccagtccccagtatcaagttactcaaccccaggcaagtgtgacaatctcatagtcacctgagtgcaggaggtgcacaggccatatctgtcaggcctcctagcttcgattcagtatttcttgtcatctgtgattaagtcatctgtccctgaacaatgcccatggagtttctatgcctgtttaaggaagctggcagccttgcctttgtatttggaaatatcgttccccaggcttcactgctctcagctttcatctggatctcctttaagtcagcttgcttagctgcacagtcaccctgaaatcaggacggaaacttttcttctttactttgctgatatatttccataaagcaaggctggaccctggttctccaccctgtcaatgcaatggctgatccaatgtttctttgtagcatcgtggattttttttttttttttttttttgcgatggagtcttgctctgtcacccaggctggagtgcagtggcaccatcttggcttggtgcaacctctccctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtattgcagcaacactcttagaaaattgtttgaccaatttttggagatttttttggggaaaaaattttgtttaactttgactcaggcagggaatatggcattatggtctacacgtagagggagattttggcctgtgggtctggaaagcagggtcatctaattctcaccaaagttaatctaggacaccctagaatattcctgtcagaatccttattcttgcactgagaatagttatgtccttgtgctatgactggacagtgatttgttcctatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgtgtctctatctcctttagttctgctctgatcttagttacttcttgtcttctgctagcttttgaatttgtttgctttgcttctctcgttattttaattgtgatgttaggatgtcaattttagatcttttctgctttctcttgtgggcatttagtgctataattttccctctacacattgctttaaatgtgtctcagagattctggtatgttgtgtctttgttctcattggtttcaaagaacatctttatttctgccttcattttgttattttcccagtagtcattcaggagcaggttgttgagtttccatgtagttgtgcggttttgagtgagtttcttaatcctgggttctaatttgatggcactgtggtctgacagtttgttgtgatttccattcttttacatttgctgacgagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccattatgattgtgtggagtctaaatctctttgtaggtctctcagacttgctttatgaatctgggtgctcctgtatagggtgcatatatatttaggatagttaactcttgttgaattgatccctttaccattatgtagtggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgagtacagcacactgatgggtcttgactctttatccaatttgccattctgtgttttttaactggggcatttagcccatttacatttaaggttaatatcgttatgtgtgaatttgatcctgtcattatgatattagctggttatttcgcccgttagttgatgcagtttcttcctagcgtcaatggtctttacagtttggcatgtttttgtagtggctggtaccggttgttcctttccatgtttagtgcttcctttaggagctcttgtaaggcaggcctggtggtgacaaaatctctcagcatttgcttctctgtaaaggatttatttctccttcacttatgaagctttgtttggctggatatgaaattctgggttgaaaattcttttctttaagaaggttgaagatgctggagaggatgtggagaaataggaacacttttacactgttggtgggactgtaaactagttcaatgattgtggaaggcagtgtggcaattcctcagggatctagaactagaaatactatttgacccagccatcccattactgggtgtgtacccaaatgattataaatcatgctgctgtaaagacacatgcacacatatgtttattgtggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtggggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaatatatatatctgtatatatatatatacatacacacaaaaaataataaaggaaaactatacatatggaaaaaaaaagaatgttgaatattgctcccactctcttctggcttgtagggtttgtgccaagagatctgctgctagtctgatgggcttccctttgtgggtaatccgacctttctctctggctgcccttagcattttttccttcatttcaaccttggtgaatctgacaattaagtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcattaatttgatcttgaatcactgataccatttcttgcacttgatcgaattggctactgaagcttgtgcatgcaccacgtagttctcgtgccatggttttcagctccatcaggtcatttaaggtcttctctacactgttcattctggttagccattcgtctaatcttttttcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggtgacctacagatggggttttggggtggatgtcttttttgttgatgttgatgctattcctttctgtgtgttagttttccttctaacagtcaggtccctcagcttcaggtctgttggagtttgctggaagtccactccagaccctcaaacagggatttctttgtgttgcctattctctcccatgtgtttaaatccagggagaggtgtatacatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctgtgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcaccgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgcagcacatgcccaggagctgtctgtcagctcagctcatctgaattaaatgtctcttgccagctacaaaattccttatgagttttgttcccaaagcatgtctgtgtggttctttacctgccgaaggccagtgtcacccttgtctacctctcagtgaaagatgtgacccaggtttcactgaatttattcccattttctgtgtcttctaagttcgcttgttttagctcatctgtccatcatgttcctggtacgttttctagataaacagctgacttttcacccacaaaagccataatagctgatgcttctgtgtagaaccaagtttcattttgactcaagagctggtacattgcaccccttcatcaaatctctgtgtccacaatctcataaactatcaaattctgggtatttaatgagagaaagcttaatattgaagtatctctcctatgaggtgttagaactatttgcctacaatttattggggaaaaaattgctcatttgtgtacataaacctaggacagagcacatagggaagataacattccaaaacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggtgagtctgagaaattgtggagagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacacttatcatttactaacctagtgaaggttgaccatacctcaaaagctgtattctcatggtaactgcagggaaacttgagcacattttatgcaaaattattgaggacatgcttttcatgatcactgttcactgtgtgtcctgagagcacaaatacagagtgtcctttgattccctcatcagtgtgtcacctgaccaattcactgagctcgctctgtgtgtgtgtgtgtgtgtgtgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctgggactgtgtggtttctgattccccctggcttattctttactttttcccacttttccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatccttgctaccatgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatcgtgatcagccttcaggcctcttgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattgtgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgaccactgttcgctgtgtgtcccgagcgcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatccgtcctttttctttttaaacagttccttatgttagccatgaaatctagctggggctgtgtggtttctgattctccctggcttattctttactttttcctacttttccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgttgtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgagaagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatcactgtatgctgtgtgtcctgagggcactaactcagagtgtcctgttactccctcatcagtgtgtcacctggacaattcactgagctcattctctctctctctctctctgtgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttacttttttaaccacttccttatgctacccatgaaacctagttggggctctgttgtgtctgatttcccctggcttattctttactttttcctccttttccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaattggccattactgagctgagagatgtcattgccgcagtgaggacctataggcacatgtaggttgaatgaaactctagttctacctggaagcccagacaagggatgggtcagtgagcaagactctcttcctagtctcaggccatgcctgtggcactctgattctactctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaaattgattggaaaaatatggcataactgtttgcacaaacttgggacaaatgttattgggataacgatctactagaatagggacactttacccacagtttttgggagaaaaactgaggaatttatatcatgaccagccttcagacctcctgaaatatatctctcatggtgtcgtattcttatgctgaggagcctgaggtccctgtgtgaggattagacagtggattgttatatgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagatgacaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctgatggccactgcatcaaattttgagcatattttatgggaaactattgagctcactctttttgtgatcacagtttgctgtgtgtcatgagggcactaactcagagtgtccttttactcccttaccagtatgtcacctgggcaattcactagctcactttctctctgtctctgtctctgtctctctctctctgtctttctctttcattgttttctacctggccctgttctatcccaacataaaggcaataaattttttttttttacctcattaatgaatctatcctttttcttttctaaccacttccttatattacttctgaaatctagtggggctctgtggtgtctgattttccctggctgcttctttagttttgtctccttttccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtttattttctaatctcttccacattgtaggctatgtttaccatacgtagcagaatgtatttacatttcttggttctagtcatttgtattcttcgtgagtgtgagtgtgtgtgtgtctgtgtgtctgcgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttactacctcctttacctgccacttctcataatagtatttgaacctaaacatataccggtgacattctgtgattatcatcttgcccctaccttggttttggtttttggtgcagttccaggctcttggtgtctttgtttgggacaccaagagcctggtactgcacggcaccagctggtaagaattaggcttttttggccgggcgcggtggcttatgcctgtaatcccagcactttgcgaggccaaggcgggcggatcacgaggtcaggaaatcgagaccatcctggctaacacggtaaaaccccatctctactaaaaataaaaaaaattagccgggcgtggtggcaggcgcctgtagtcccagctactcgggaggctgaggcaggagaatggcctgaacccgggaggcggagcttgcagtgagccgagatcgcgccactgcactccagcctgggcgacagagagagactccgtctcaaaaaaaaaaaaaaaggctttttttttccctaaggtttaacaacaaaccagccctttggaaagacttgcttcaccactgttaccaaccaacggcctgatgctttccctcagttttgtgattttgacaaaacaagcaagcagcattccctcctgataagagaccaccgacctaggaatgattctggccagactagagaggatgcacagtgagggttttcatgtcctctgcttcagcttttgatgtcagagggccacaaactccactctcagatgattgctaatgccaccattttatgaacatggaccccatggagaggcacgaagctcaattgcacttctgcacatttttcctcctataaatattgctattggaatattatttggtacggctcccgtgaaagatacatttgcagaatgtactcaaattagaagcatcatgtaaagcctataatgtaccgatagtgcatcaacttccctacactatagaaatatctgcggtgtagacatttccacaatgaccagatatgtgtacaacaaaggtggctgcagcattctttgtaatcctaaaacaatgaaacctacctcatctcaaaaactttatttttttatttttattttttttttgagatggagtctcgctctgttgcccaggcgggagtgtagtggtgcagcctccactggtgcagcctccactgcagcctccacctcccaggttcaaatgattctcctgcctcagaatcccaagtacctgggattacaggcacatgccaccatgcctggctaacaaaaacattttgaaaagggttaaataaatcatgcacaaactgaggaaaaatactcttcaaaaatgatggagaggatcactatgatgatgaatgattccactggtcacattattgatagagcaatcagtaaatccaggcacatcctcgggatattactgacctcctattattaacatatgaaaaaatggaggcatgtaaattactcgtttaagcgtataacggactgaattagaattttatcacaccagaagtgggttcctaggtctctgtttcaggattcctgagttacacacgtataaacccaggatttcaggagatacccggttaagaatccggtcggggaggtgggctggcccttgacatggataagtcacaaattagtggcttaggactccaggaagataaaatcttccccatttatctagtgattgacaatgcatgaatactttaaaagctcaaacaagcgtccctgggtgggctcgaaccaccaacctttcggttaacagccgaatgcgctaaccgattgcgccacagagacaggtactgtcagttctactgggcgctataggaagggcgcacgcacgaaacttcctccctcccttgcatcctcagggcccgcccggcaggacgactgagcaaggccttggaaaaccggagagattggagcggtaagtcgcgctggtcacgttggacacctgcgcgttgggagattctggagccagaaggatagccgaatggccttcgcccgccctgcccctcgcctgcttcagaaaccccccggaaacgccccggttgagaccccggcccgagccgcctgggggccctagggaggctgaacgcccggtggctcccgggatggctcttcccgttcttcgcgccgccttcacccagtgagggagcctgtgccctccctgcccagtcgcttttggggccgctgcggagcttccgctgccatcttcggatcctgtgttccgcacgggggctccaccagggcagggatagtggtgagggtggctcgtgggtccccctcgcggggagcagggtctggcactcaccagggcgcaggactaggacttgtcgaatgaatccatccttttagcttttagtcctttgaagagccttgagaatggaaatcatgagagatttttccatggggaagttccttttacaaagcatttatttacgtggacttcttggcaccccgcggggcggcaacgggcagggcctccagtgccccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgctactattttatgattgcaaataattcggcagtgatcattcttgtacacttctcattggccatttgtgtatttctatagggtagaggcctggagagcagttgctccagcatagggattacacagtttttgtttgtttgtttgtttgtttatttatttatttatttatttttgagacagagtctcgctctgtcacccaggctggagtgcagtggcgccatctcagctctcactgcaacctccgcctcccgggttcaagcgaatctcctgcttcagcctcccaagtagctgagattacaggtccgcgcgagccaccacatcgggctaatttttgtatttttagtagagacggggtttcaccattttggccaggcaggtctcaaactcctgacctcaagtgatctgcctgccttggcctctcaaagtgctgggattacaggcatgagccaccgcacccagcgattacatgttttttttttatatatcattctattttctttccttatttggcttattagctgtaactctttcttttgttatgtcagtgatggctttagggtccctaaatacatctttatccgtctgccatcaagtgacattatacctccccttctggcctttatgctagtgttgtcagggaatttgattttggacatgttataaaccccaacatccaagtacgtacatagcgattttcagtcgtctccatttctttgtgtaggttcagatttctgtttggtatccttatccttaggcctggaggactcctttaatatttcttgtagtgtggttcggtgaattctgtcatttttttgtatgtctttaaatgtcctgatttcagtcacatttttgaaagatatttcaatttggcatagaattctagaataactttttttctctcagtactttaggatgttgccactttgacactttgtcattgacatatctttcctgtttttgtaaacttggcataaagtgggtttcctgtacttgttatatgatttttggattgtgtattcaaattaaaagtattaaattaaaattaaaatggcctgggcgaggtggctcacacctgtaatcccagcactttgggaaggggaggcagaggatcgcttgagacccagagttggagaccaccctgggcaagatagcaagaccctgtgtgtgtgtgtgtgtgtgtatacacataaatatgtatatatattatatgtatgtatgtatatataagtcctacagtcaccttaagttccaccaacagtgcacttaaagtaaaatgtgcccaacctgaggctcaaacctacctgctggcacgcaatttgtgtttgtgagacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttcctcactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttgatctacttccaactctccctttctatttatttatttatttatttatttatttatttatttatttgagacagagtcttgctgtgttgcccaggctagagtgcagcggggcagtctcagctcactgcaacctccgcctcctgggttctagagattctcctgcctcagcctcctgagtagctgggattacaggcgcctgtcaccgcgcccggctacttgttgtatttttagtagagacagggtttcaccatcttggacaggctggtctcgaactcgtgacctcgtgatccacccacctcggcctcccaaagtgctgggattacaggcgtgagccaccgcatctggccctccctttctatttcttcaagacctttttcggatccctcctgcgcaggacctaaacgggcggtgcccttacccactggtccctccctgcctggtgtcttcggagccctagctcacccggaacgttactgcccgccggtgacagcgagaggaccaaagaggaccaaagagggcagcgggtgtggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgccaaagttcagagacctgggtttcccgctgcttgccacacagaaaaccgatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacacggtgaaaccccgtctctactagaaatacgaaaagaaattagccgggcgtggtggcgggcgcctgtagtcccagctactcgggaggatgaggcaggagaatggcgtgaacccgggaggcggagcttgcagtgagccaagatagcgccactgcactccagcctgggaggcagagggagactctgtctcaaaaagaaaaaaaaaaaaaagaaagaaaagaaagaaaacaggaactagggaggggcaaggaagcaatcaggatgaatgaggggtccggcgtctcattgtctgggtgactttcagttctttgatatcttttttgagaggcctgaaggaaggaactgaaataaaacaaatatcgagtttcaaactttcagatcagaagggtccatttctatgtttatccaaaaatctacgtatgggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggagtttgagaccagcctgaccaacatggtgaaacctcgtctctaataaaaatacaaaaattagccggacgtcatggcgggcacctgcagtcccagctactagggaggccgaggcaggagaattgcttgaacccgggagatggaggttttaatgagccgaaattgcgccactgccctctagcccgggcaacagaccgagacaccttctcaagcaaaaataaaaacaaaaagctgcaggtggaaaaaaaaaagtctggattttggttcagagtccctggggccttcctcagtagttttctctttccttaaaaaaggaagcttgtctcagtctctgcatctctctgagtccttttggagattgaggatggtgaggtctcagtgcttggcccccttctaactctgggtacctcccctcccgtgggtcaacctggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctctggtggaggaactgacacccgctggagaaagtgtggagggaagcgagggctgcacctgcacgcaggagctgaggcaagcggcggttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagacttagcagggtattccgccaagacataggttagactgcggttctgatctgcaggcctcgatgccctgcgccggggcaccagggcacgggcaaagccctccccctacacaaagcaagggtgttatgcctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaactgctacgaaaaaagaaaaagaaaggaaagagaaagaaaagaaaataaaaaaaaaaagagaaaaaactagccgggtgtggtggcgtgcggttgtcctactcgggagcctgagatgggaagatcgcgccagttctccagcctggacggtacagcgagacttgtcttagggagggggggaaaaaacaacaaaaaaaacagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccatccaacagagactgaaattcgcctcccaagagagtaagtggatagttctaagctgtccccaaacatggcctcacaaaggaaaactaaccgttgcgaacggaaacaactgaccggacagaacacagccacaaaacacgagcccgcaccctgagttacaaaaacacttacggctcacctactattcgcaccacagaagcaccaggggaaaacgcgaacacagtcccctactatcacaagttatgcagtcgagttcctcacattgggggaaaatggcaggggtcagtacacccggaacataacggataagcctcgccctgagaaaaccaccttcgtgatcatggtatctcccccgccaagtaagtatgagcttttgcacctccgccccgccacagcctcacacgcttcaccctttacacgcacggtcacttgccccgcgcacgccccccccccaccccccccgcccccagccctcctagccctgacacacagctgggactctcaggtccgaccagcggtcctgaacccgctcccacggcacgggaactccttagtggcgaagcagcagcccctgcgctgcctcatctacatagaaatcgccctatccgtgatgtcaccgacagcgcctttcccagacaccgtctgctcttccgccccaccctccgccgactcagccgatcaaaccgctgccggagctggcggaggaagtgacgtctgtctctttctccttttcctcctgccattgtcctttggggaggtgcgcagagatcccacgtctggtctccccctaagactgtggtacttgatctgtgtcctgcagagaacccttctggcggccaacaggaagcttgtgcacccttcttcagataatgtcttttaatgcgcagacttgaacgtttaggattacaaggaaaaccggttcctttcaaacctgtttatctttgtgatgtagcattccgtttcaagttgaaagccattcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatgttagtattttatattctccaaagacacaaaaataatcccaatttgacaaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagaatgtagcaactgaacactaaatgcttgatccaggtgccattcctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcccaactgacattacaacagcgatctcaagactttttgtagcaataagacaccaaactccaggctgactctagtgtagcattacatgacagatagcaggccctgaaagaaatgaaaatattttaccctaaaatacattttttatcatattttgaaatgtccctacaaagttgtctcttgtggggaaagtctacatgctatagggaatccctttccaggccttttccctaatctaggcacctttttaagtctgataagaaacatttacaatcaattctctctgaagcctgttacctggaggcttcatctgcatcataagaacaaccccttaacacagagactgccttctatggattccaggtctttagataaactctttcaaccaattgccagtcaaagtatcagaaaataacggctggtaactatgtaattatgcatatatatgagtagaattttgggggtggacacagtggctcatgcctgtaatcccagcactccctcaggaggctggcagattgcctgagtccaggagtttgagaccagcctgggaaacatggtgaaaccccatctctacaaaaaaaaaaaaaaaaaaaaattagccaggcatggtggtgagcacctgtggtcccagctactcaggaggctgaggtgggagggttacttgagcctgggaggtgaaggttgcagtgacccaagcttgcaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcattcagtcttggctctggtgggaaacaaggggcacactcggatgtgtgatttaaagagagttgtgtgttttttttttttttttttttttgagatggagtctcgctctgccgcccaggctggagtgcagtggtgccatctcggctcactgcaagctccgcctcccgggttcacgccattctcctgcctcagcctcccgagtagctgggactacaggcgcccgccaccacacccggttaattttttgtatttttagtagagagcgggtttcaccacgttggccaggatggtctcgatctcttgacctcccaaagtgctgggattacaggcgtgagccaccgcgcccggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagttctgtccagtgatcctccccaagacaaccgttctctctagtaactatggttttcctttctcatttcaattgccacctcaattgactgaaatgtgaacaccaactcccgcacttaaacgttgaagccctaacacctactgtgatgatttatgcagctggggcctttgagaggtaatcaggattaaaagaggttatgagagtggtgtcctcatgctgagattaatgccattacaagaagacagacactagaaagcttgcttgtccgccttccccctggtgcacgaagaaatggtcacatgggcacacagtgaatctacagccacttacaggccataggaagagaccttagaaagaaatccgctttgctaccacctttatcttggacttcccaacttccagaagtgtgagaaatacatttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtgcccttgggtataaatccaacttcttcattttaatggtgagaaaccaaaagcccacgtttcctgatttctggcccagcactggaactgttttcatggcacgtcaattcatcatacattttaatagtgatattttatatttgcataattttattgcctttgcaatgggctttcacatctatcttctcatgtgtatatagtttagaggccatttttacccactatctcctaatcatatcgaccacagcctcaggaaatgtctgctctattatttcacttgcctgtctgggttcttgggcaacagcatagaatcctgcactgtgttttccctcacgctttctcactctttgcagaacaaatttttgttacatgccttattatcatggtaatattggccttcagtcctgtatagaagcattaaaaatgtgcgtaatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacgttatctttctgtagtgctctagcattttctaagcattttcacacactgttatctctttttttctttctccttctagaaattaattatgacttttcctttcaaaaatgaaggacttttttttttttttttactcttttcattttttcctgagaccatatgtcaaagggaatgtgaggaacaactttggtgtggtaatagccaaattcctccaggtctgctcctcaagcttgcaaagtcaagactggcagaagtggtgatttttacctgggtatcctgagaaacttgcacagtccttatcacatgcaggtgttcagagtgtgcaaataaacgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatcccctatacagtcctgtagggaggcaagaaaacttacaaacgaagtggtaaagaaagagagagattaagcaatttgccccaaatctcataaccactaggtgataagtcttcaactagaactcaaatatctgactgagaattcagtgcttttttcatttaaatcacattgcttcataaaaatagatctgcaggaagaataaaaatgtccaaagtgcaatgagacagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatggctttaatctcttatttattttgactgttgagattttgtagccattatccaaataaaacatttattttcactcgtgagtccctaatccttcgtcaatggaattagctatttatttgatgcaatagctagaccagtagggttaaaaatgcttttataaagacattaatagctgggtatggtgatgtgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaacggaaactagaaatcattgccatcagctttctctaatgtgtacttgatccttttctccctgtgatggaagtcgaaagtctttttgtttttttcttaatccactactgttcaaatgagaataaacagccaaatgactgaattagttggtagacataattcctagtcttcaattatttttatattcttttgtaatacagtcattattttttcagacttctataatattgcatttaaccaatccccaaatagggaaacgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctacccagatagagagaagtcaggcagggctgtgctgtgaaaatattagagaagcttgatgggaggcctaatatagtttgtctttacacctgtatattttgcttcttgcatctgcttcaatgccctctgtcatttattataactagatatattgttctaatagatttgtactacagtcagaacaaacaaatcactggatccagcagaagccttagatatatgacataacagagatttgcacaaagatttgccccattgccttctcaaatttctcttatcatcaatccatctagctggagctctctgaaggtcatcagaggtcagtataattttaataagattttaactgaaggctagccttgatgttcagtgaccttcagacatgtttataatcgagaagccactccccctgttgaatgataacctcttccatgaattaccaaaccaatggtgctcacattctgattaacgattgattcccataaacccagcttcccccaacactgatgatctaaataacctgaattatttgcattgccttatcaattccatctcatttcctgtcttggtggttttgctcacactgcttctatgtggaatgtccgtatgtagccacttgagtttccacttcatcgttccatcatctgtagtctctatacactatccatcatcaggactaatgtgagctgactttcctccaaaaagctttccctgaacttatcctgaaataacgtttttctctgctaacttagcatttgtcacgttagtatacagcttctctaactgtcatgaaatgaaataaatgggaagaagatgaaacatgaaaagaaatctgctccttaaggcaggccctgggggaatagccctggctggaggtaatgtaaggtctagatggtgtttttagaatctgaagactgcaacaccaaacacaacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaatggctaagaaatagtaaaattaacacatggcctaaaatattaagaaattatgcctgttacagaattacggacctggctagtatataggagcattaacaacacaaaaacagattaggtcgggattagcagtgggggtgaaataatcttcagggctgaactactgagctagaaatatttaaatcctccttgcagatgaaaactatagaggacaatttattggttcagcatgaatttctggtcttctgttaagaaatacgctctttcattgaaagtgaacattgaggcagtaaactccaaatacagctgcaggtactatctcctgctgatttgtgtgtatagagcatgaaagaaaggctcagaaacaaaagcatgttggaaaaataagcagaaggagacatttacttgcaaagaaatgtgaggaagtcattcttcaaaagaactgcccaaaaaattaaaaaaatagaactttttaagacaaacaatattatgaagacaatagggcttatattaatctcttcatggcagaaaacagcaattttatcatggttattgtattcagaaagttcatgacatatcttcagacaataaacagcattgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaacgggccgacaatggtgtcaggccccgatgtcactttggtttttacacttcatcttgcggtcatgtttccttctctacaggacatgtttgtctacctccatttgctgaacaatgttcctaatcagtactattgattttacattttaatttgatccattttatttgcacagatctaagaagtgttgattaatatttaatgacctcctagtatttttttgatgaaacaataaactaaggctcacaagtttacgtctatctatagatttataaagcccttgtgctttaaatttacttttacatgtttaacagctcagtttagagcagaccaaaccagtccgttcacctctacctgatttcatctgcagtatttataatgcaaatgtatcctttttaataaaagttatccaatgtctcggtgtccctgctctgccaagaaaggacattctttcttacctccaagcctgagattgcatagtccatagagcaagcaccagattggtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctgatgcctgtaatcccagcattttgaaaggctgaggccggcagatcacctgaggtcaggagtttaagaccagccaggccaacatggtgaaaccccgtctctataaaaacacaaatagtagcctagcatgatggtgggtgcctgtaatcccagctacctgggaggctgaggtgggagaagtgcttgagcccaagattgagaggttgcagtgagttgagatcacgccattgcactccagcctgggcaacagagcaagactccatctcaaaaaaaaaaaaaaaaaaaatttctaatcagtaatatattcaggtagaagggaggacaaattcttattgaaccaatacaaataactacatagtcacataaagtaaatgtttttattaaagaaactttgtgcaagatttaagcaatattgctaattaagtgtatgttaatagacaaaaccaaatattgtatgtcacaattctttacaaaataattatttgtatgtttttcttggcaacttattagctttgtttttatattaagaatttctgcaaggtatttttttcctcaacactaagaattcagagtgttttatttagtttttacaaatttaataatttgtacatttaattggagattaaaggtagattaagaagaaagaaaatgggtttctctcatgttcattaaagtagaaaattaaactagcctcaattaaattgccttactgaggccctttaatcctaaataacaacctcttgtcgtgctggtcttgagttaagcagtctactttcatgaattcatcggcttctacactgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatacttcttccagatgactcaaattctgattggcgctttgtagagaggcttttaggtatgcttaaagggaaaggagggctaggcacagtggctcatgtctgtaatcccaacactttaggaggctgaggcaggcagatcacttgaggtccggagtttgagaccagcctggccaacatggtgaaaccctgtgtctactgaaaatagaaaaattagccatgcatggtggcgggcacctgaatatagctactcgggaggctgaggtaggaggacagcttgaacctgagaggtagagtttgcagtgagctgaggtcataccactgcactccagcctgggcaacagagcgagattccatctaaaaaaaaaaaaaaaaaaagcagcggggatagggggaggagatgttgctaataataaaactgtaaagtttggttaattttttgccatagcaaacaacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagcaaattaaatatctggagaatgcaaaacattacctttatttctaatatatcttcatgttaagagctaggaggaggatctctggagtttcccagcagccatctgagaaacccagagatactgtattcataagtaacatctcagtagttttactattttggatttgagggttaaatttggggaatatggtatcaaaaacagtgtcacaggtgggggctgcagatgtgaagggcctgctatcaatcaggtgaccctggatggactacccactccctgtgtcagtccaggatcccagctgtagtgggttcctctctgctacagcacatgtttctaaagggcaagaatctgggctcccaataactgacctctgtctcctccatcctggcttgtcatggtagacccgaaccaccctcccattgaatttgggcccttgtggctcatagccacaagggaaattgggagctcacatgtgaaaggcagaattaagttaatgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggaacaagaaagacaacatgacttctggaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctgtattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgttgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcacctgtaatcccagctactcaggaggctgaggcaggagaatcactggaacccaggaggcagaggctgcagtgagccaagatggcgccattgcactccagcctgagggacaagagcaagactttgtctcaaaaaaaaaaaaaaggctaatatatggagattgatttatcattttatcaaaaaggtaacccaaacactaatatgacttttttgagaccatccatttaacaaattggactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagactcatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccatgtagggtatgtgtggttttacctatacagtataattatttgtagccccatctcaagttacaggaacaaatgttttaaaaaatactagtttaataattcaattcagctgagccataaatccagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttaaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaattcattaattttctccagagataggaaaatgtacaataatttgttcagaagatatttacatacatacaacaagaagtcattatgaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctatcaacagttagagctctccatttttcaagctatgcaagattgtctccaatagttatggcttcagcagtggttcagcttgagtgtgcatcagaaccacctgcaaagcctaattaaacggattccttggctcacttggcagtatatgactcagtaggtaagatttgagaatttgcatatctaacaagttgtcgggtaatactgataccgatgtctagggactatgagaatcactaacctagagtgtttaaaaaatgaccaatttctgtgcccaattatctgccaaagtttcctaagagaaggaaaacaacaacaacaaacaaacaaacaaaccaaaacagagagaaactgagagaaacagccacaactggaaactagtaacacaaaaacaaaccattgtaaaggctaattaacttattttcataccaatggggaaagatttttatttcattttgcactcacaaaaagctttaggagttttttcatgtgccagaaggaagcacataacctccaaattcacaatctattctttgcccgtttgctgtagttactctttgtaccaaaggttctgagtctggagtctctgcttccactggtcagatagactctctccttacattgtggtctctcactgaatgttctcacccactgcttcctcactacgtaatatctgcccaagaagctccccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatacaaggtaagatcaacatttgaagtgattgagtttaaacataaaaagatgtattggctcctgcgactgggcagtcttcagggttagttgcttgagtgatcaacgataccattaagattatgattgggacatgaaaaaaagaactggcaaataaggagagaactttgacaatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactgagaataatcatcacaccattctgtctcacattctagaaggctttgtagtggtagaactgtaaacaacatataaacatttctgaaatattgtggttgttttatcttccataaacctcacacaagccgtgtgtatgatcatccatcttctgggccattatctgattattgctgctatctctcgctttggggaaaggaggtccctttccttatcaatactattggatcagctcttctaatttcatgatgacatgagtgttcaggaatgatggaaggcaaatgtaactctgagaaaacttggtttaactactgcatttcacaagtccatatccatcctagaaggtcttccagcctgctctctgccttgctcccaagatggccacatgtaggtctcttctttcccgtaaccagagggttatagattatattatccttcaaagtctgggataaaccaatttctcactctaaagagaacaacgtgttttgatttttccaaccctaaccctagcctaaagtctaccttctaatcctatcttattacaaatgtccctggattgatctttcaagggatttttgcctactgaaaaaatattactctcactcaaagaattgtggcctgacaagaaatctacaagagtcttggacacagaggccaaaacatcataacatctggattattcaggataaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatttctacttccttgaaattttattgagaaatccatcattttccaaacttttctttctattggtgtaaaacagggatgaatggccatgagcacttcattgcctcatctcaggtgacacttctttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatggtttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaggaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtattttttttaaaaaaaaaatatatcagaaaaagttttggagaattgcaattgaaaaaactagcagactaactgcatagcctagaatataaaaaaaaaaattaagaaaaagctatgtacatcctgaatgcataaagtatatgtatatattaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaacaatagcacatactgtactacccaaataattacttttattttatttttataaatgtgctaggtacaagcatacttttattatatgattgttttgttatttggatatattgctagtggtgaagtctgaggttttactgtactcatcaccccaatagtgaacattgtacccaataatcatttttcaaccctcactcccctccaaccctggcatcttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctctcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaagagaaattcataaggcctcatttcatgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatgacagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccaggcagaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcctggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacctcagcctctagataagggagtcataaggacctttaaggctctacatatggcactctatggaaaggtttgtcaacattgcaaaagagaaacccaatagagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagaactaatacacaccacaccagaggaattaacaaaagatgacttcatggagatgagtgcttcctaaccagtgccagataatgaggaagaagacataggaacagcagtgccagaaaacaaattggcattcaacaatctggcaaaagaactttgattattcaagactacttttgacttcttttatgacatagaccgttccatgatacaggaactgaaactgaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaacacaacaatgatgaagacctttaggatgatccacttccacttaatgaatgggtcatatattttctcttccttacaattttcttgactataatttcttttctgtagcttagtttattgtaagaatacagtatataatacacatagcatgcaaaatatgtcttaaatgtaacgcatgttatcagtaagccttctggtcaacaataggttattagtagtttggggggaatcaaaatttgtatgcagatttttcactgtgtgggaggccagctcccctaaccctatattgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcatccctgaatccttatcagcaatgaatttttaaatatactataagagatgaaaaaatttttttaaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttaaagaaaagagtctataagacaaaggtcctcataaattaagagaagccaagacagtcactgtgactgcagaatattttaatttttttttattatactttaagttctagggtacatgtgaacaacgtgcaggtttgttacatatgtatacatgtgccatgttggtgtgctgcacccattaactcatcttttacattaggtatatctcctaatgctatccctcccccagccccccaccacagagcaggccccagtgtgtgatgttccctttcctgtatccatgtgttctcattgttcaattcccacctgtgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcgtttctctgacggccagtgatgattgatgatgagcattttttcatgtgtctgttggctgcataaatgtcttcttttgagaagtgtctgttcatatacttcacccacttgttgttggggttgtttgttttttcttgtaaatttgtttgagttcattgtagattctggatattagccctttgtcagatgagtagattgcaaaaatgttctcccattctgtaggctgcctgttcatgctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtataaggtgtaaggaagggacccagtttcagctttctacatatggctagccagttttcccagcaccatttattaaacagggaatcctttccccatttcttgcttttgtcaggtttgtcaaagatcagatggttgtagatgtgtggtgttatttctgagggctctgttctgttccattggtctatatctctgttttggtacaagtaccatgctgttttggttattgtagcctcatagtctagtttgaagtcaggtagcgtgatgcctccagctttgttctttttgcttaggattgacttggcaatgcgggctcttttttgtttccgtgtgaactttaaagtagtttttttccaattctgtaaagaaagtcattggtagcttgatgtggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcatttttaaatcctttcagcacagagacaatcaactgactgtctgggtactacctgaccactattggagtctctttcatctgcctgagtctgtgcaacaatatgaaattataattttactatgcacctaaacgttcctcaatatattgaattcttacagaatttgaagagtcaaattttgtaaatccagttacctttttccactactctaggcctcatatactatctggcctaagggttaaaggtccacaattgaataagccaaacttgttaatttgaaggtaaagcatgtcaagaaatctggccttaatgtccaatgaacttatgtcatattaagtagctggatagaaacatgcattccaaagtggatactgtttatcaggctcagtgtgctctattcttgacggtaaatcccagaatagggtggatgctttaattttgtattaaatagtattaggtgtaatatcaaaaccactaagggaacactaatgatgagaataggaacactagctgtggagctggcaactttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtcttccaatgtgttttcatacattttctttctgggatcttgagtgaaacatgtggatctagaacaagaacaaaatgatgttaccttgatgatctctatgtagggtcacactcaaggcatcttaaaatattttgctggccaacaaaagacacctcctgttctaattgggcattgtccttttctttaaactatgcagacaaacaatattataaagtgagaacatccgcataaaaaacctaaacataaatcttaatagtgagttcatgaaaattcttactgatgaaatggcaatgtcacagactgactgtttatgtccccccaaatttgtatattgaaatcctaacccccaagctactcgtgttaggagatagagccttggggaggtgattaggtcatgaggacaagattctcatgaatggaatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccgtttactcactgttcctctttattttagtttcacatttttgctatttatctctgtaattttattcattcttcacaatttgccattcttatacttcgaatcatgttatcagtttataatacctccatcaaatgatagtctgcatttgtttatccttggctgattcaaaacacttggcataatttccttaaaggaaatcatcttcatcccacctcacaacactgtattattttcaattaatttccaataaactcttaattgtccatgctctgtcagagttggcagagttaatccctgtttaagctaataggttcaacttcttcaacaaacaaatctttcatgaaagctgctgacaagccagagtattaattaaatctagtttcattgcttctcactttccttgatccttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcgagtacagtatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttattcatttaaacagcaaggtacatttcattctacagatatactatataatatttactccgatctctggatgagaatttatgttgcctgtaaatattgtatcacaaacattataagaataatctctgtaaaggttttcttcctgaattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacaaataatgcaatattatacaagggagattaataggtagaaaaagaaatgcaatggccaggagtaacagaagatgttcaacatcaatccaatcaaattaatgcgtctttaaaatgcaatagcagtcaatgttagcaagagtgtaggtattagacattctcataggaatataaactaaggccatgttttaggatcatattagatcgcagcaattaaaaaatgttaaattcatatgttgtatagcaacttctcaggttggaatttatcacatggagaatcttgtaaaatacataaaccaagatatgttattaatgttattggtagcctattgttttaataaaaaatatatttatacaatacagttgttaaaagttaagaatatcttgaaggtaaattattaaacaaaaatagaaagcctaggccaggcaagacttcatctcatgcttataatcccaacacttttggagactgaggcgggaggattgcttgagcccaggagtttgagaccaacctgggcaacacagtgagacctcatctctagaaaaaaaaaaatacaaagcctagttctgaacatccttttgtgtaatactaaaagataaaattttattttctatcttgtttaagatctatattctatacgggggatgtgtattaaggtcatttttaaaaagatactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccatggttattaatcagtctcactgactacattttctgttttacatcccctttcaggcactactgcagatggccaagcatatcacattatgtaaataaaataaaacaaaatcttttcccattgagcaaatggatatacttcacctctaatgcttccagtctttctcagatcattcaaaaagcatgatatggtttccatgaaaggacattcatcccatttgactaactggaatttctttactccagctaatctttaccaaagagctgaattaattcaagttgacaccctgttatctaccagctcttccagcccttttgcttgattgttttgtcattttgccttttcttttcttctaaagtgggagtatggagatttacccttctgaaacagctgtgtcacatcatgatccttgagaatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggggcccagtgggagataactgaatcatgaggatgggtctttcctgtgctgttcttgggttagtgagtaagtctcatgagatctgatcatttttaaaatgggagtttccctgcacaagctgtctctttgcctgctgccatccatgtaagatgtgacttgctcctctttgtcctccaccatgattgtgaggcctccccacccatgtggaactgtaagtccattaaacctctttcttttgtaaattgcccggtctcaggtatgtctttatcagcagcatgaaaacagatgaatacaacaatactgtaacaaatcgactcacatctgttctctttataggaattgcagtgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcatggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaaaaaagaaaaagaaaggagaaagaaaggaagaagaggaaggaaggaaggaaggaaggaaaagaagaaagaaagaagaaagaaaggaacaaagaaagaaagaaagaagagaaaaagagagagaggaagaaagaaagagagaaagaaagaaaagaaaaaggaaggaaagaaaggaagaaagaaagaaaaagagagaaagaagaaagaagaaaaggaaagaaagaaagagagagagaaagaaggaaaagaacgaaaattcaagtcctgccttgtaaaatgcagtactccattttcccaaagagatcccaagggaaacttaactacaggataaagacagacaaaaggacataaattacaactactctaggttcacatattattttgtttctgaaatgggttttaaaatatctatgtcagagttcatttctagaactttatctctagaaaacatattttcacttctcaatacaggaaaatggagattggaaaaatgagtttggaaaatgatttccatgcttatctctcagcttcttttttcaacttccctttttcatctccgtatcttcactgatacctaggaatctctgttacatcacagtcttcaagagctttgctcacagcgaattagttaagacattagctttcaaaagtatatgatattctctcacaagcatttgtctacttttaatagggcaagctacgtaaagatgttaaatctcattccagaaataccacatctattctacctatttatgagaacagtcgtctctagaccaagatagaaattcatagttaggaaataaatccctgtagggtttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaatgttattttactgaattactcattgctgttttctcattttttaaataataaacacttattaagaaacattggaaatataccaaaaatagtaaacaataaaacagaaaccattggcagaaatagtcactattaaaatcttaatatactcccttccaatgttgtttctgttaatgcaaattaaaaaatcagagattcgcctctgtgaactagatctctttttacctttagatattatttgacaaatacatagctcaatcatctatccaaacttctcttttacagactccatgccaattaaccttctcctatgaaactattatttcttcacataggataaatatggttattgacacacaaactttcttagttacactgcaatccagttgtgcgttcctaaatttataccaattggatttagaatgatcattactaaagaggcttggccttatctcttgcaatttgcttcttccttcttaaattcaattcttgtaatgtaactataatttgggggtatctttttgcctcatattcaaattctctttcaaactgaggtacatttctgtatttctgtatttgtatattgcatataatagtatagaaaacaataatgagattatagtgtacataaaagttttgaagtataattaaatatttaatatataaatatattaaatatgggctgctgactcaccaagcctggtttggcttccatcacttgtgtaatcaatcacctgtattaaatcacctctgcttgaaagatgaagaatagtttctgatttataagcaaacactgaaagctcttctatttcttgtttgctaaacaagatttgtcaaagttaaatattttattttattgaattcactttttgcctctcctacaatgatgatttgcttttcctcctttaacttgttaatgtgatgaattatacatagtttttttttctattgttagaaatccttgcattcatggaacaaacacaattttcatactatattttttatagacttctaaacttaatttgctaacttttaatttaaaatgtttgccgttaggttcatgaggaaagttggcatgtaattttcctgtcttacacatttctcatataacattggtatcaaggttgtactggcctcataaaatgaacgaacaaatggacctttttttattctggagttgtttttataaaatggaaataatccatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgacgaaaagccctcagatattaaatataaccttaaatataaccttcccccaattcaatttttcttttgcagatatgattagatactctaatttttcaacctctatttcacatatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaaattcagtttcaatctgcttaatataagatacatacactgtctcaatttatattcctggcacacctcattgattttttaaacatattaaacacagcttttatagttatataatcgtcctaatatctgaaatctttatgggcataattctgtttctgctcatgatgtttatttcctcatgagttttgtaagagtcttacatttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggttttttttaacttatacttacagtgaaaatttaaaccacaaattcatgtgaagatggccttctcatttttcctctaaatagcaccgagtttgaggcaggaaaatttcctggttgtctccccctgaggaacaggtttttatctagtttatcctttcactgaaattatagtccttcgtatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttagtttctattcaagtcagtaatatacttttgaaaaatgacatgtacattttatctggtatttgtagatttcatatagcaggatagtgattcagcaaatttagtctaccacaatgctgggaatagaattcccctaatttttgaaaacattatattaaatcatgtttattgccattaatagtcttataaatgtgcttttaactaactgcattttgtcatagctcattgtgattgtatatttaactagttcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctgcaaatctgacaaagatgtgagaaggcatcttatagtttcaatttgtatttctttggtgaccaatgtactaaattactcaatgtactaaattactcttttcctgtttatgatccatttcaaacaaaatgtaaaccattttttaaatttttttatattaatgcaaatcgtaaatcactactttatttattcaacttcctaagcaaaattatatgttgtcccatttatacattttatattagatctttctgccttacatttataacctaaaaaatgtcagaattatataataatgatgaacagttgattataaataatgtctttattaggatatttctccataaatctaaatttcatcaatctttctttaaatatctctacacaatgtcctcttgtattatattaataattgcagatacacttctttttgctatttctattctttcctattcctattgtctgttagtctcccattttctcccataaaataaataaaaatttttctatcagattctgtgatatattacttcttattcccagccttcaacattttaagaattcatattgaccttttctcccattcttatttcaagttatcagcatgttgatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataatgataccaattcaagaaggagaaaattgatgtactgataaacaaatgggcatcttaggatcatgtttctcacaagtaaggcagttccagaaattcctaggaccataatgggttttattctaaataggttaaacatatcacttaaaaaattgttttctacagttctctaatattgcttacaattgtccacgtttccatgtttataaacttgcacttttttttttttatggagttttgctgttgttgcccaggctggagtgtagtggcgtgatcttggctcactgcaacctccacctcccaggttcaagcaattcttctgcctcagccttctgagtagctgggattacaggtgcgtgccaccacacctggctaattttttgtagttttagtagagacggggtttcaccatgttggccaggctggtctcgaactcctgacctcaggtgatccacccgccttggcctcccaaagtgctgggattacaggcatgagccactgctcccggccttatacttgcacactttttaattctaagaccttgctactcagtgagggatcctgggactaataccatcagcttgacttgaggccctctttgaaagccgactcagaatctgtaatttatcaggatccccaggtaatttgtatgtgcagtctagtttggtagatctgctctggcagactggaagactcttctatctgcctcatgtaaggtgcaggtgacataattaggtaatcaagcaaaagatcacatattttaataagaaagagacactggctattattttgagtggtaaaacaggttattcagtcccagtttaaaatggaaatgacagagaccaagatgaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacgccagctaacaaaacatgctatccaggctctttcgtttcaccatattgctttcttgaaaacataggacagtgccagtttagcactgaaaaaaatcagttctcctaattctaaaaagaggagacagccaggcgtggtgggtcactaaaaatacaaaaaattagctgggcatggtggtgcatgcctgtaatcccagctacttgggaggctgaggcaaaagaatcacttaaacccgggaggtgaaggttgcagtgtgctgagatagcgccattgcactctcgcctgggcaacaagagcgaaactccgtctcaagaaaaaaaaaaaagagagagagagagaaactgtaatttcatttcagaagttttatagggtagtatttccaattctttttttcttactccattaaagtgtaattagcagtatgtgaaaatttccactttatcctcaatcagaagcctctccttccaattagcatatattttttctattaactttgtaaagtgggattcttgttttatacatacccctggaaagtatacttaaactgtgagaccctgggattttatatttccaaatagaagataccatcctcttgtatcacaaaatgtacctaagatggtttggattatatttaaatattcttgaatgaaatagacttactgactgaagccaattattatatttttccacaccaaaataaatgcaataggaaaagatgacagttctatgtagtattcctgcttccatattgcacaaattagaaacatacatattccattatgttacagggtctagggctttgggaggacaaggctgcaggcagccgagattgtgccgctgcactccagcctgggcgacagagtgagatcttttctcaataataataataaaagtaaaaagaaatataatatttaatcaatatatgcacacacatgggtttatcatgacacacatgacatgtgtgtacagtgaaaaaaatgagtaaatctagaaacctgtattgcctcaatagctagctaagtacttcaatatgcatgtttatttcaacaattttgtgttaagcttcagtggtaaataagcagagtacactgaccataatgaatacttcttttgatgagggttatcactacacaattaaaatattacatagttggctgggcacgttggctcacacccataatcccagcactttgggaggccgaggcaggcagatcacctgaggatgggagttcaataccagcctgactaacatggagaaaccccttctctattaaaaatacaaaattaaccaggcgtggtggcacatgcctgtaatcccagctactcaggacgctgaggcaggagaatcacttgaacctgggaggcagaggttgtggtgagccgagatagcgccattgcactccagcctgggcaacaaaagcaaaactccgtctcaaaaaaatatataataataaatatatatatattatatataatcaatataaatataatatataataaatatataatatgtattatacaaataataaatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgtttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatatgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctgataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaattttttttatttttatttttttagtttttttaagagacagagtctcgcagtgttgccaaggctggatgcagtcacgccaactcagctcactgcaaccttcgccttcagggttcaagcgattctgctgcctcagcctcccaagtagctgggactgcaggagggcaccacgatgccccactaatttttgtatttttagtagagatgtggtttcaccatattggccaggctggtcttgaactcctgatctcatgatccgcccacctcagcttccctaagtgctgggattacaggcgtgagccaccgcgtctggctgcatgaccttttaacttgtctcatacactcaatattctcaagatataccttccaaagtgcaaaattatggcactttgcagccctgaccactaactgagaactttgatgctttggattttggagacctcattttatcacctggtccttttacttcatgacttgtcatgctgccaccttttgatgggattgagatgaagataataattcccaactggtcaggaatattgtgcccctttgtttttatatccagatgcaatagagcctctgacacaccactactattgttcttaggatttggaacaaaatgcatttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcagcagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggctcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagcgaaactctgtctcaaaaaaaaaaaaaaaaaaaagaaaagaaaagataattagggactcggaaagacaaagactgaaggattggtggcaatgagttttggggaaaaaatatgtagatgaaccacagaaaatgagccagagtgtaagaatatttgtgcttaatacgaatgctcaccaaactatcatcaggaaggttatcaaatagatatgaaggtatgaaacaatctctttcaccaggcactacattgcttgcttagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttattggaactcctctatgataaaggcaacaaggaattttgtaaatggaatctacctttaaccttgaattacatttgctttacctgacatcatttttctctgatcgccactctccacgggtacattgaatgccttatatatattgccataatatcctgttctacatccttctcttaaaagaacttgttgtataacaaatgagtagatattcattggactcacctggtccaccatttatcctatcactaaccaaaattattattattacagaatggtgaatattttattaaagactcaatcacagtgccagctggagacaatggcttataaggttgtactcatgctagaggatgtggtggtgtatcctctgaactagtaactaagtataagcttgtctggtgtctcctatataaaaaatacaacaatctttgatatttgttatgaatgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaacagtcaaaaatttaaaatttaaaatgcggctacactgtggcatggggtagtaaatcttgaccttaaaactggtatttgtaagaaaaacagaaagaattcagggatcccctttgatggctcctaattctatacagtcctgtaaatattcctgaagactaaccaggcgtggtggtgcacacctgtaatcccagctactccagaggctgaggaagagaatcacttgaacctgggaggcggaggttgcaatgagctgagattgtgccacttcactccagcctgggtgacagagcaagactctgtctcaaaaaaaaaaaaaaaaaaaaaagaagaagaaagaaagaaagaaagaaagaaagaaagaaagaaagaaagaaagaaagaaatgaagactgccacaacttggaagcaaccaagatgtccttcaataggtgactgcataagcaaactgtggtatattcctacagtggaatattattcagtgctaaaaggaaaaaactatcaagccacaaaaagatacagaaaaacaaagacattttgctaagtgaaagaagccagtctgaaaagggtacatactgtgatttcaactatacaacactctggaaaaggccaaactataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacgttggtaataatgtaatgatgggtacatgacattatgcgttttgcaaaactcctagacctgtaccacacaaagagtgaactctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatttcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaactttgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaatatttactatttgatgtttgttcctgtgtttgaggaattcctcagcctctcagttttgacgaaaacaagaaaccacctcctgctttagaagctaaaatgtcaaatgcttgctttctcagcctcctttgcagctatctgttgcaaagcgaacaagtgggagtggtgctggtggctttgcagttagcctaggattgagcaattgctgcaattgttgctctctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaatgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgagaggttgaggcaggagaatcacttgaacctgggaggcagaggttgcagtgagcccagatcatgccaatgcactccagctttggcaacagagtgagactttgtttcaaaataaaaaaataaaaataaaaaaataaaaacgtaactggatagacctaaggatcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaacaaaatatatagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagtttttttcatttggaacacacactcattccccagtatactaggggtaataataatttaaagagtttaattactttttactactagaaaactaattttatgtttggcacaaatttctgaaatgatattccactgcaaagaataatacctatatatggccagaattacttttcttctataacattaagataatacttgtcagcctgagcaacaaagtgagacctcatctttacaaaaaatagataaattagacgggtgttgtggtgatgagggtctgtagtcccagatactcaagaggctgaggtgggaggatctcttgagcctaggaggtcgcggttgcagtgaactatgattgcaccactgcactccagcctgggtaacagagcaagatcctctctcaaaataaaaataataaaaaaaaagataatattggtataattcagggtttttgcctcaatccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattaccccaaaaatatgacctgctgaatttctgctgtcatgaattgactaacatattttgggcctaaaacctttacatttagaatctttttgtttcgtattggaaaatattgtaagtcctccatttattggtcaaaagcactgcctatttatttccatgcttaatcagagagactttccaatagttatttaatattatttacgttcattcacttgttgactatattgaggttagttgctatgatatctttaggtcattaatataataaaaatatgtcaacttttctcttccaatgtgtctttgggttattaatttttaactcaggtatcaagcttgtaaaatgtttaatggcttataataatgtctaacacatagtatccactgagttctgataactctggtttatcaaattctctttttttgtaccattctccaaatgcaatgctatttggttttatttttattttttaaaaatgtgctgcctgttttgagtctctaaaagtgtgaaatgctcagcatttcccaaatgtatttgaacatggagtgttatatttactaaaaagttaacaagcaagtattcccctaaacactctagcaaatactactagtacagacaaattatgatgtaacattatagtacattttaacttattaggttaattttggttgcaaacaatcaaaattcaaaatggcttgtataataaagagattttgaacaatagtataggctcaagatagcctaatgcagaagtttaataatgacacaaaataaatgcttcttgtcctccctgtttcttcactctaccttaagtgatatagattgaatgtttgtatcccccccaaaatttgtatgtttaaatctaatccctagtgtgatgatatttggcagtgggtcttcggggggtgattaggtcatgaggacagagccctcatgaatgggattagtgcccttataaaagagaccttagagaacttccttgccccttccaccatgtgaggacacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaacacattaggtctcagttttattctatggcttaaaatatcatgtcatgagtagacaacttccaatcctagtacctcatgcttcctctgctgcatttggaaagaaggcatttccctcttcaatcatggaatgaaaaagttgtacttcattctgatttgattagcagaaggcacaggttccttccatgcaccaattacaatgaccaagaattgggcatgggactcatgtcacttaaacattgtgaagctgagaaattcattatttggttaggagtgtgtgagagcagggaacactgaatgcttgagacaccaccacgatgtccactacatgtatttccatttcagtaaacatttccattaagataatgctagaacaaaatcagaggagtagatcttggtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacacctctacatatattttggaggcctttacacaaaagtgttttccctgaagggagaagagaaaagttgaatgcagaagtagaaaaaaaaattcatttgcacttgtagtatttatatctaaatattttatattacagatgtattaaaatttttataattttaaacactactttaaaacagggagatggtttaccttcaaaaaatttggctctcaactcaaagttatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcaaaagaaaaatagctggttttaaggaatgaagggccatgtcaactattggaagcatctttgaactggagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagatagtaaagactaatcagacacacacacatatgcacaaaaagagggagagagagaacaaaaatcctatgaaatacattttaaaaacttaatttttttaagaagaagcatttgatctgccaaagagaagagttagcagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataacttcttgtccattcttgtatgtgttatggtttctttcttagaaagaagtatgctatactagtatacatactatttattcatgaaccttgcacttatcatgtaatcatatgtcttagtggtcttttcataatagatgtctctctttcccacgctgtcagtggtgattgcatgaggcattgtacagacgtaccaataattacttactctgtgtcatattgttggttattcagattgttttcactttgcccttgcagacaacactgcaatgaacatccttatgcatatattattccaaatacatcatcgtcatggctgtgtgagagaaatatacattgttgattttatttttttattttttataatttcaacttttgattttagatacagtgggtacatgtgcaggtttgttacatgggtatgttgtgtaatgctgaggtttgcggcatgattgatccgatcactcaggtactaggcatagtagttgtttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataatggcatcgagttgcatccatgttgctgtaaaggacatgattttattcttttttatggctgcaaagtattccatgacatatatgtaccatattttctttatccaatccacagttgatgggcacctaggttgattccatgtcttagcgattgtgaattacactgctgattttaatagaaaccactaatttttatgccaaaaaaatcatcaatgtgcacatgctccaaggctgtgtgagcatagcccttttccttgggatgtcaacaacactgggttttatcaaaatataatttttgccaatttattagttaacaaatgctaactcagtgctatttggatttgaactaccactggtgctgagcaactttttacatagtcactggcaatttatttatctttctctgttgtttatctttttctgtgtaataattttccctatcttctactcttttaaacattaagttttcactgttttcttaataatttttaagtttaaaaagtgaccttttggctgggcgcagtggctcacgcctgtaatcccaacactttgggaggccaaggcgggtggatcacaaggtcaggagatcaagaccatcctgcccaacatggtgaaaccccgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactccgtctcaaaagaaaaagtgaccattttatctgctgcatataattctaatgatatttctcaattcgtttatcttttaacaatggtaatatataatgtcttgctatttagaaagatttttaaaagtattttacataaagaaatttttattctttgccattaatacttgcaggtttggaattttcaggacctcctcaaaggccacctacaggaaatgctcttcaaagacatttcactttttccccacttgattgtggagcaaagactaacactggcaatgctttgaagtacttgagtcaaatgggtctctcatgtggtcattactatactcactctcaggctccaatgcaaattgtttccttacgccaactactcttgctttcctttaatagacctattcctcctgggctgtctgaaactaacatttcattgtaaataaagtcctgcaaatccttggtatctcaaagaaccctccttccatttagttttaggagaactctccttctaaaactctattcttctccctggagtccagatccccattccttgcaacaaatgaacgcttgatttgagcactgaagggagataattggaagtttgactttgtgttctaggttttccctgccaatatatgcagcgtctttaaaactaattgggctgaggcaggagaactgcttgaacccaggaggaggaggttgcagtgagccgaaattgcaccattgaactccagcctgggtgatagagcaaggctccatctcaaaaaaaaaaaaaaaaaaacagcaaaaagaaactaattaggttcaagaagttcgaatgaattcaacttagacaagctcttaagcagacatgttggaagttccagaaaagacagtttgggaaaatattttattaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttgttttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctccccaattctcttggctttaacaataaccagatgactccagaaaactattcaaaattccggacctatggagactttgcacccagatatgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataatcctcacagtaattttatgagataagttctatttattatccctatcttaaggatgaggaaactgtggtttaaagagcttaagtaatttgggcaaatcatgaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagtttttagtgcatagcatagggcttagaaaggagaaaatgatgaaaaatatttattaaaataattgtttttctttgatagttgttataaccatctaattgtgagtgcttaacaattactataaaggagaatggaaatcacagatcttttcacagaattttttttttttttttttgagacagagtccagcttgtcacccaggctggagtgcagtggtgcgatctcagctcactgcaacctccacctcctgggtttaatcacttgccttggcctcctgagtagctgagattacaggtgtgcaccaccatgcctggctaatttttgtatttttggtagagatggggtttcaccacattggccaggctggtctcaaactcctgacctccagtgatccacccatctcagactcccaaagagctgggattataggcttgaaccaccgtgctgggcctttcttagagaatttatagtttacctggaaatgtaaactatatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagagaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaacatttaatccctggaaaaaatgatgacatcacactgaaatcttgactcataagagaacttttttatgctgttccctaagtcagtttatttctacttcattcttgcgttaagggtaggctcaattcttactcattcaaaaacggtatcacctgaagcttttctttaattcttgttttctctgcagtgagaaaattaaccaaggggttaaaatgtatattaattatatatgtattatatgtaaaagttatataatatagatcagagaagaatatattgcatatgttataggctgaattgtgtcctttccccaaattaatatgctgtaccctgccccctgccatcccagtatatcagaaggtggctatatttggagatagagacttttaagaggtaactaatgtaaaatgaggtcacatgtctgggtcctaatccaatatcactggtgtccttatttgaagaggaaatttaggtacagacatacatgtgcacagaaaaaagtccatgagaagacaagatgagaaaatgactatctaaaagccaaggagagaaatttcagaataaaattaacacatctgatgccttgacctcacacttctagcctccagaaccgtgagaaaataaatttctgttgtttaactcacccagtctgcagtaattgttataacaaccctaacaaagtaatataggaagtatatatatatatatatatatatatgtgatagagtagatagatagagacatatacagtcatccctcagtattagcggggtattgcattcaggagccctgcatataaggaagtctgcacatactcaggtcccacagtcaaccttgcagagctcgcatatgaaaagttggccctcaacatatgtgggtttcacgtcccacaaatactatattttcaatctgtatttggctgaaaaaatccaccaataagtggactcacacagtttaaaccagtgttattcaaaggtcaactgttgatatatagatatataaatatctcatatgtatagagcaagcgagagaaaaaatctctaatctctcttccttcctgctctttttggattgcaaactcttctctcataagtacaaaaagtaatgttaacaaagtaaagagaattggaaatagtagtgtttttgaccactagtgttttgtaattttggaaaaaaaaattactgaaatgtaactttttatttatattgagatgttttgactcatactccaatcatacagaaataatagataaaatatgaaaaagacttctttttacatacatagctggattaaaatattagaaataattttcttccctcaaaggatcccctatttaataaacggtgctgggaaaactggctagccatatgtagaaagctgaaactggatccctttcttacaccatacacaaaaattaactcaagatggattaaagacttaaatgaaagacctaacaccataaaaaaccctagaagaaaacctaggcaataccattcaagacataggcacgggcaaagacttcatgaccagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccatctaaccaaggggtaatatccagaatctacaaagaacttcaacaaatttacaagaaaaaagcaaccccatcaaaaagtgggcaaagaatatgaacagacacttctcaaaagaagacatttatgcagccaacagacacataaaaaatgctcatcatctctggtcatcagagaaatgcatatcaaaaccacaatgagataccatcacatgccagttagaatgatgatcattaaaaagtcaggaaacaacagatactggagaggatgtggagaaataggaatgcttttacactgctggtgggagcataaattagttcaaccattgtggaaagcagtgtggcgattcctcaaggatctagaactagaaataccatttgacccagcgatcccattactgggtgtatatccaaaggattatacatcatgctactataaagatgtatacatgcacacgtatgttaattgtggtgctattcacaatagcaaagacttggaaccaactcaaatgtccatcaatgatagactggattaaaaaatgtggcacatatgtgccatggaatactatgaagccataaaaaaggataagttcatgtcctttgcaaggacatggatgaagctggaaaccatcattctcagcaaactatcacaaggacagaaaaccaaacaccgcatgttctcactcacagatgggagttgaacaatgagaatgcatggacacagggtggggaacatcacacactggggcctgtcagggggtggggggctgggggacagatagcatcaggagaaatacctaatgtaaatgacaagttgatgggtacagcaaaccaaaatggcacatgtatacctatgtaacaaacctgcatgtgatgcacacgtaccctagaacttaagattaaaaaaaaacatttcttccctcatgaggtacaaagccaagcattacactggggccatgatagtccaggttgctgaaagatttagatctaaagactgaaaattgggatatatattgagagagagagagagagagaacaaatggtaacctaaatttaataaaataataatagacaaattagggtaacaggcatatgagtactttttgttctaacaattcttttattttcaaacttatctatgatcttacatttatttcccaataaaaaggattttaagttaaaaaaagaaagtttttctttagtaacattttcacaactagggcctttaagactgaggaaatactccaagctctgagcaaactcagtaagtataaatccatatgtagacataccacagtaaaatgcaagatactaaacactaatacaatattttcaaatcaaccagagacggaaggcagattacctgcaaaggaaggacaattactttatcacagacttctcttcatcaacgagaacagacaatacaggaagaacatctcccaagttgtgagggagacgaacagatgacatgaaattctacgaccaaataaagcataattcaatgggcagcagttaacagaattaagctgtttccagacatctatggagagatttaactcaaagatgtcactgtaaatttgattgttgagatgtagtaatggatacttggcaaggttattgaattagttaaacgatcttcaaagcttaggtcatgtatcttcattaaacacatggtgctttgcatttactaaagaagggcctccgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatggtgtcaaccgcatagcagttatttgattggcccattcctttataaaatattttatgcttagatgatgaactctacataaattcagccaggagaatgttttccttggcaatctctgggagattacaaatgttcctttttttttttttttttttgagatggagtctcgctctgtctcccaggctggagcccagtggcgcgatctcggctcactgcaagctccacctcctgggttcacgccattctcttgcctcagcctcccgagtagctgggactacaggtgcccgccaccacgcccggctaatttttttgtattttagtagagacagagtttcaccgtgttagccaggatggtctcgatctcctgacctcatgatccacaagcctcggcctcccaaagtgttgggattacaggcgtgagccaccgtgcccggcctacaaatgttaccattaactcctccttctgctaagaaataaaccaaaataaaattattcacaaatataactgttttgatcatgctttcagatgatatgtaaagtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccactgtgataatttactacataaaagtacaagttacattatataaaaagaatggcctggctcagtggctcacgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttgaacctgggagacggaggttgcagtgaactgagatcgtgccactgcactccagcctgggcaacaagagtggaaactccgtccccccaaaaaaaatgactccaagaaactgaggtttccagatgagggttacacaatgtggatctaaaagcaacagggaaaggaaaaggatttgggcctagaatgtggggaattttagatgctgcagaaagccttctggtgtctttctagaatggctggattttggttaaggcaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcgcaaaatccagcattagcaaagaacactgccaagtttaccaaagaacccctcattctcaatatctgatcaggttcttcattcttcaccattctgcaggtgatgtctgatcaccctggccagtcttcagcaagaattcttttagggcggtttagccagaatctcccttactcctgatgtttcctcttagtgattttccattcactgacccctgcattgctcctgggctataaattcccacttccgcatgctgtattcagagttaagcccatctctctccccagctccaagactgtgttgcagtggttcctatatctatggtgatggtcctgaataaagtcttctttactgtgcatttgaagtatcactgaataattttttctttaacaactatggtgttgaaactcaactaggacagattcatcactggatcctgggcctctcactcagaaccctaaatgcatgcctttgaagtctttgttgtcatttctgactgattagggatccattggtgaatcagattcctgagccattgctccagacaaaagcccgttgatggctaaggacagattttgaatctgaagggatgaatattctctctgaagctggggtagagtcccaggcttcttttgaaagcaatcctctgggcaggaaggtcttcgtgtgggcttcttgttctgagtggtctattctctgagtccctaggctagaagtctcttctttctggctctctttttctgagtgaggggttattccctgattccctgggctacaaattgttcttcctggctctctataaaaccactctgctctttctcttctctctattggatcctgcttctcccatgggagctctgtcacctgaaacccctcttctcaagtctctgctgactatttccatagctggtagtcacgacgaggagacaactgtgtagggtcaatatttgggccaaccaccctgaggaactgtgagggttagaactggaaattgtcaagagaatccgaacccagctaccatataagagagttcaacttatgttcaatgtgaatgccatggcaatattaaaaggtaagaattcaatccatacgtgcttgaggtaaataggagaaacctagaatttatgtaaacagtgagaagattggatgcgttttccgtctcatattttaatactggcagcatattatatatgtcaaaccatcaggcattcagaaatacatgcttatgaaaattttttgcaccatcagacaaaagacaagggtagaagacatttgtaaccctataaacactagtaaattaaaaacagaaggaccttaatgtcctaacatacctgtgttgtgaaaggctgccctgtgaaataccggatttcttaaacatattttaaaaatcataggcgtcaatattttttagatatccttttaaattttctcttgttattttacaatgcctatttatttatttagtggctctgctgattttgatgtatatccaaaactttatattttctttaaaagatgttttatacaactttacgtaaaatgtttctgtatcttcacattctctccctgtccttttgttttgctcttatatggtggtcctgagtcttttctctggcttttcaaacctagtaagactaagacactaaggtaactttgcccgtggtttggtaatgccttctaaagcacatcctaagctctcgtgcatacaggggtctcctttgagctctgtgcttttgagatcccatacacctaaattccagtactccaaatcagtactgctcagttttagtgactaagtttaaaaatgtattttaatagcaagttagtttagtgccctcttgcttctttcttgactgcttgtatacatgtatattcctttaaatgaatcttggaatttatttagaaatattaaattatactaatgaaactgtatattgttgtgaattcataagtgaatttggaaagaatttgtctttatgatgctaaatcctttttatccaagaatcatatgtgtctttatatttattccagtctatatttatatcactgagtaaatacatagaaatgtggatacatacagctgtagttacagatacaaatatagatatagcctgttaaatctatatctatcccatataacatatatacatgttatatgtgtgtgtttatatatatatgtttatgtcattaaagagctcccttaatatttttcttttatttcccataaaatttaggtcgagcttgaattttgcttgtataaacaagtaaatatttatactagttttaatactgatgtttagacattgtatcttattttagtgctgaatattttcacaattattataaatatcatctaataataataatgtacctgataaaaatatttaaaattttacctttgaattattttattgttgaattaaaattcctttaatatgatagtcaatttctgttttatgctttctctatgcatatgcaaattaatgtatccacttctctgtctctatgtagtaacatatgaaaatcaggcctctcttcttctaatggacatacacatgtttgcatatagaatatcagactctttatagcatttaaaacctttaaaaacatgaatattgccttttaacaaacatattttagcatgtactgagaatcccctatttatttttaatttgggctaatcaatacgattattaatattactggattaccaaatttggaaacacactttcatcccgaaggtggatatttgtttttttttttttttttgccaatttcttgtcttactgtttcaaatattgttggatattatttgtattttatttggcattttagtatcaacatttgtaattgaggtactctacatattttttcatcaatatctggtgggtttcatagttactgctatattggatttgtagtagacattgacaaaaattattcctgtatgttttatagctgtatgaaggaaactaatatattttacccctaaatatatttccttgatatatttcaaaatggctattgagaagggctggaaaagcaatgttagctgcaaagctgtcttggggagatttgcatcggtagagaatctgccctgatgcagccaggttttctctgaggtctgcccccttgtctggatctaggaaaggttaactgagaggctaagtctccaaaggtctgaaagaaacattttctgtctattctctctgaggactactcccagtgaggttccacctatataataagtccactgttgctagccagggtcgttttctcacataacctttttctttcttttccctgtgatccaagaccccatttttctgtaaacttcatgtggtagataagcttctgcacgcatcgtgtgactgggtcttcgttctaagggttccagtgtacacacattacagaaacctgcatgccttttctactctttatctgcctcctattagtgattttcagggagacttcagaagacaaaagggacattctcctttagcctattctcagaccaattcccccaacatttaactgattcctaatagcttaaaatcactttgaaaaatccatatatttataaccttttcttccctctatgatttctggtcagcttgggttttgtttttcattccatttacttcatcctcgaaaagatctattttacgtctatttattctcatttatggacattgagaaaagaaaataactttcatgtgagaaatgcaagtcctttgaaataatcaggcccagagagatattcaaatgacacagcagttctgtcctgctcctctttgagctgtgtgttcatctaggctgcttgctgttgccacagtagctataaattaaccaataaggccacaccagacactataatccacaccccataatagtgtaacagtgtgtagccagtcactaataaatgttatttccataagccaatgagaatttgtgacaaacctctttgcgtcatcacacttctggacccttttttgcctttaagtaactgcttgttgcaaagctccaaagggagttcacatccaaggatatttgggtctgtttcttccaggcagctgtcctcactgtggctcaagtaaactctttgaattacattttgtgcttcagctccttccacttagattaacaacatggatttgtgtcaccatgtacagcaattaaaatgtttacacttttcccctcgagagcactgatgtgttttcctgagcacttggaatagctacgtagtgtttcctgtctagattatggtttctcaaccttggtgctacttacctttaggaccagaggattctttgttgtgggaggctgccctagcaatgataggtgtttcgtttgacctctaaatttcacacctccaccagtcttgacatccccacgataaccctagacattgacaaatgtctcctggggaaaactctccaccagttgacaggtaaagttctggaaatattggatttgtcaattgagattttatgttatccaaaacaaatatttttctttgttcttaaacatctacttccatctacttatctacttatttttacttttatttgtaacttaattccatcaaggagagagagtgcattttctgttatgctaaatttttgaagaatgtattgatattttatgacctgatatatggatgatatgtagatattacatgtttgtattatcaaatttcagggtgataataaaataaatacttataatatttatattgtcactgtatattagttattttctttcttcactacaggagtttttcaacctataggctatgtttcaattctaggttatccagtagattttgaaatgttatgattaaatatctacttctcaagcattcatctttgcaaatgaaacaatcctaagctcttataatacacatcatataaagggcagattagtcaatgtatggttcagaaataattaagtaatatttataagaaaattaaaaatttatatccttaactcagataacaataatccaaattaaaatttgatttcattacataatttaaaatgacatcagaatgctagtaaaaattatacaaaaaatttatgtaatcttattaagctgtgggactttattagcataaattcaaatacaggaaccaaagtaagattgagacctatagtcaaaggttaaaatgtacacattataggggcatgattaaactaatttaaagcataataacatggagaaatattgcaaaacatacattttactgaattaattgttagtatctaatcattttgtgagaaccaaattaaaaagtagctacacacgcacacacccacacacaagtgcaatactgtcaaataaacgatgttcagctacactagaaatcacacctgtgttttctccacagaaaagattaaaaatcacaataatttttattgtacatatggaggtaaagatactcaaaatattaccctaaaatacattatttttttgagatggagttttgtttttattgcccaggctagagtgcaatggcacaatcttggctcactgcaacttcagcctcccagggtcaggtaattctcctagctcggcctcccaagtagctgagattacaggcatgcaccaccacactcggctaattttttgtatttagtagagacggcgtttcaccatgttggtcaggctggtctccaactcctgacttcaggtgatctacccacttcagcctcccaaagtgctgggattacaggcatgcgcctggccagctttttgacatatttcacgatggctactcggaagactggagatagcttcttctacaagaatagctgaaaagctgtgtttgttggggagatttgcatttgtagagaaaatctgcattgatatagacaggctttccctgagatactcccttgtctgggtataggaatgattaactgagcctggcacgtttacatttctaaaagccatttcctatctatacttcccaagaggagggctgctccctgtgaggtttcatccatgtaacaagaccacctctgctgccaggctcctctttcttccttgtcgtcacctgtcttccacaaagcctgatttaccaacctacagctctgtgttttctgcaacctcaagacagcataggcgtgttgactaccttgcctttcctggagtttttatataaagagtatatatttgtatatctctttataatatacaaatatttgtatagatataatatatatattatgtaaactccaagtgcatacttgtgcacatatctgtaaacctttttttcctgttaatttgtacattatcagtttgttttatagactcaaataattaaagcttcaagggaaaaatttaaattttcctatagagaaaagacaaatatataggtgacaaataatatttagagtgtaagacgctttttaaaggtatatttgcaatttgtgtcaaaacattgaaatgtacatttgttattttaacaataaaatttcaattaatttaagccaaatacatagtatatgcagaaaatttagcaatatatctatgtagcaccttactgtgcattattgtaaccagccgtctaatataaagaattaaggtagcagctgctttccaaatagcgcatttttttcacagacctattaaataagacaaataacatttaaactttatttttaaatttgcagaatagcagttttcagcagatggtttattttagcaaattccatcttcacattgtgctatgcttttatgagttccagctgttaacggatactattttactgctgaaactatcctgtgtgatataattgctcattatgtgccttaaaacacaagcaatataattattttcaacttggagcaaattaaaatcttatcagcaatttaaaatctctagagtcatcttcttctggttaattattttaaacttgtatttttctctttatgtttttagtgagttctcttatcaaggagaagatctcaaggtgattattcttttttttctcttccatgcacctcgcaggtgtgttaataatttcatttctcagaaaatattctttcatatctatcttacaagatgagagaccttttaatatcttccattcggatgtgataccagtaatggaacatattccagcttcatgaatatggtgatacaaatagttattcatctaacctctttcagtgccaaatgtttactatactcagtgagttactcagttgactggtaatttcttctgaaatcactaatgagaggatcagaggtctggctgttgtctgtacctcatatgactcccagtgcagacaattgtttctatggagcacagacagttgaaaggattgacttcctgcctagaatagtttctgctgtgcttcttatccttcttgtggagatttcagattacctgaattgcttttctatcttaagaaaaaacgcaacaattctcccacctgagaggaatgtaaactgaagtaagttaacagaaccaatccataaagtttttacattgtttgttgcaaaatgcagcgctggtgtctccatcactaaccttttctatccctcattgctctttctttgactgcaataggatacctctatgcaaatctgtattcccgagactgagtgcccttttggtgagctataagcacactcaatggtaggctgaaatactagtttttatctatggcgaaatggaatcatatcagtgaattttttaaaaaggaaatttaactcttgctgtggtttgaatgcttgccccttccaatctcatgttaaaatttgatccccaatgttgcaggtggggctcactgggaggtgtttggtcatggggttggaccttcatgaatggataaaactctcccttagaaatctaaagctatcctccctcctcggtgccctcaggaatgagtgtaccattccttattcacctatgattaccccacccatcctttttgagatattgactacatgtatgttacactgatgcacattgtctgacctatgagtgagtttctggttttcttattttagtttaccgtttgtcctttagtttgtaatgcttctaatttgttctataaatgttctgatgttagggtaaaatccattacttattctatctcatggaatttttatttcaagtatttatttttcatctatatatgtcacatttttcattttataacttttatttttctcctatatttaattttcatttaagtaccttgacatatatatgtatttatctatatgtatttataaaatatatttactttaaggatcttgaaatttccttcttttctgtcatttataaatgacttatttttatcctgttaatatatattttaattatatatgtcttacagcttctttgcatttcagagttttttttgggtattttgatgttatgctattgaatatctagattttattggctacctttgaataatgttgtgacaggcagttcagtaacttcaggatgagtatttgtctgttgttttaaatcttctctttaaactttgttgagttagtctagagccatctgtaatttggagctaaatgagcactgtcactagggcatgaacctccagtggtctttactgaatatcctggaggtacagaggggattcccttctctgattagaatttggaatataaagagaaaagagaaaaatagaaagctatgcataaacacgtgcattaaaatgaattttatgtgggctttttcatgaaaatgttcctaaggtattttattttttttattgtggtaaaatacacataacataaaatgtactctgttaaccattttaagtgtacagttcagtggtactaaatatagtcataacattgtgcagccgtccctaccatccatctccataattcgtttcatcttgtaaaactgaaactctatacccattaaacaatacttccccatttcctccttcccccagcttctggcaaccatcatcgtaccatctctataatgctaatcaagcatagtggctgtgtttcttgcttcctctagtccgcaggtagcatacaaatgtaataaactacttattcatgtcgcatctatttattttctgccttataccaagcttgtgggattctcttaaatacaacatttttatacttacacctatgcaatacccattagcatcgccttcctaaatcaggggaaattgagcttctgtcaggtggagtaacttcctaagatataaaactcagcattgaagtctgtatacttcaatatcctgccctcttctcatgtgtctttactgccttttatgtatgtgttagatgttcaacaaattctcttttttaaactgaatttaagccgtggagcagtgttttgttgaacaataaatatgatataggacactcttcctccttttcatgtatgatcctgttcatgaaaaagagaaattctttcattgtgctagaagcttaaaataatgaaaatgccactttctacattaaacagaaactgaagggaatcaaggtgaattgcatgagacatagaaaacaagtgggaaagaaatctagtataatttgccctttgtgtacctttattatttagcgtttgagtaaatgattcccccaaatatcttcccatctcaattcatgtctataaagtagacgtttatgtctcaccttgtcaagaagggcaaagtctaacataaacatttcccaaaaatgcttcctgctaaaacgtaagctcagtctggctagaaatgcagctcacttcctaaagattaattggtagctaattttgcatgctgttctctgaacttgagtgtaacctgtccgtcaggcatacagggaatgacgggaaaggtgacaacagaagatgaatgctatgtcactaaccttcaaagatgacctgccttttctttcaaattcttgatatcttaagacttcattaattcatctctcttttcccttggttcaacattttgctataccaaaactcatgtgagacaatgacctaatgtaataaaaatggcatttttctttcatgtagttgcaagctaactggcatttttacaatccacgtatttcctttgtcagtttttcattctgtattggaagtaattgatgggtatttctgaagggatgaaggtgtttctgtgttcattgtgatccaaactatttctagacctaggggcctttgtaaacaatttgtgcccactgaccaaagatcactgtggcagaaagcagcaaacttgcataagatgtcactgcttcataggttggctttgaaaactaggggcttactctatactcttatgaataaaagacattgatagatgtagtataagattacaatcatattttccttttgacagtcacattataaatcaagatgtattgcaattaatctcaattagctgatcacaattaaaattaataatgtttattattgctgataaaaatcatgtctctcctgttctcaaatgtgcaagtaattcttgtaattttaatacaaatttgcatattattattaattgatttaatctcattggatttggttcatggatccaatttattaaaatattgataatgggataatgagttgtctccccatttcatgtacattaaaaacaacatttcttacaatggtctgcaagcccatcatcatctgccgcatgttaaccgccaaaattattttatatcttcacccttgatcttaccagtggtcctggccacctcactgtcctctggacataccaacatgctgctgccttacgatcaagactctagttaattttttggcttggaaagatagcccaccatatatccattgatcagctcattcaacttcctcaggtctttactgaaacttcacattctcgatgaggcctattcagtatttcaaactgcatcccagttgcaacattccaaaaccccttactcttctgtgtatttttgaaaggatttattgagatataatttacatagtgtagagtgcacacattaatgtctacaagtcagtggcttttagtatatgcacagataagtggagccaccatcacaatgaattttagagcattttcatcacttcaaaaagaaaccccaccttccctagctgttaacctcctatgcacccatcccctactcaatcctaagcaaccacaaatctgttttctgtctctatagattttcctattctgttttcatctaaatagaatcgtacaataggtggccttttctgcccggcttcgttcagttggcataatgctatcaaggttcatgtacgtattggtactttatttctttttataactgtataacattcaatttcatggatataaccttttgtttatccaataatatttttattgacatttgagttgtgttcagcctttggctattttaggtactgttgctaaaaatacttgtgtacaatttgtgtttgaacacctctttccaataatctgggtgtatacctaggaataaatttctgggtcatatgacaattctatgtttcatatatttagaagccatcaaattattttccaaagtggtcagttctagccatagagtatctaactgtggttttgatttgtagttgcctgaagagtgatgctgttgagtatatttttatgggattattgaccgttcatgtatcttcttgggaaacacatctattcctatcatttatcagttttgagttgggatatttgtgacggagttaaaccaatttttctatattcaagatacatatatatatacagacatatagatacgtgtttttcaaatatcttctcacaattttggagctgccttttgacttgcttggttgtcctctgaaacaccgatgtctttaatttttaagaaattttaaatatctaatttttattctgttgctcatgtttttggggttacagctatttctttgctagatccaaaatcctgaagattttcccatatgctttattctacctcttgcatgtgtgtctttaattcatttgagttaatatttttgtatgctttggggtaagggttctaatttattattttgcaagtggtgatccacgtgtacgttgttgacccagtgtgttcaaagactgtctcttcctcattgaattgcacatggcaccactttaagaatccattgactgtagacacatagttttatatatggactctcaattctcttccatcaatctatatatttttccttcatcaatgttgtgttgtcttgattactgatactttgcagtaaggtttggagcatggggtgtgaattatcctaatatgttttctttcttcaagattattttggctattttgagtcccttacaatttcatgtgtattttagaatcagcttgtcagtttctagacacaagtctgttgggatacttgcagggatttcatcaaatctgtagttcaaattgtaaagtactacaatatcaaatcgtccaattcatgggtgtaaggtgtttactaattatttaaatattctttaaacaataatttttaattttgagagtaaaatcttgtatcacattttccaaattaattaatatttcttttttttatgctattttaaattgaagtgttttcttaaattcattttggggttttcattgcagatgtgtgcaattgatttttgtacatttaccttgtctgctgtaatattgctgaaataatttacgagttctatcgttcggtggattccttaaaattttctatatacaacaatgttattttcaaataaagttttatttcttcctgttcaatatggatgactcttattattttagttgccgatttgccctgcataaaatctttagtacagtgttgactagaagaggtcaaagtatatatcctattcttatctctgaccatagcgggaaagcatcctttaccattaagttgcctgcttgctgttggcttttcacaggtgccatgtatctggtgtagaaagttctctattcctggttcattgagtttttatttttatttttaatcattaaagcatttggattctgttaaatgtgttttccgaatctatcgagatgatcatgaattctcttttcttattctatggataagatgtatcaccttaatggattttgggctgttaaaccaacctgggattacttgtataaatttcactttgtcatagtgtataattcttttatatgttgctagatctgatttgttagtattttttaaggaattttgcatttatacttatagtagttttatttttctatgctatttggactaatttttgtatcaaagtaacactggccccacagaataaattggaaagtgaatatttctcttttttaaaaaagctagtcaagaattaatatcaattattcaacactaacaaatattattattataaaatattaatttctctaattttaattttcttccttctgcttgctttaggtttagtttgctattcgttccagtgccttaatgtggaacgtcatcttatctcatcctttcctttgtcttttcattttgtaaatagtgtcttgttagcatcaggtgagctccccaggttggtagtactccatgtttgttgctgtacaacaatgacaggtaatatgtcctgaagacaatggaaacttaaccttcaaaatctcctagattccaccttatatgatatgtctcttctattggtcctaatttctaccctttctctattataaaccatgagtacaatggcattcaatgagttctgtgagtctttctagtaaattcttgaaactgagggtgttcaggggaaacccctgaactggcagttggtgtcagaagtgagaatcttcttacatggcctcttcctttgaactgtgcagctggacgcaaactctgcacaatttgggccagaactctcgtgttgactttgtagcctaaagtatcttgtagtttgtctaaccctcaataaatttgctttcatcaaatattgtatttgttaccccaaaattaccatcacgtttttttttctccaaataactaacataggagaaatagccagctgagtttgtaactcaacagaaataagtgatccatataccatataccatataagtggccatttcattttgccttcttccaccaaatcttagcaacctcaaccattaccaagagccactgtaggcctaccagctacaaacaaacgagtatcttgtaaaaacacttcatactcccatttgataattttcccagcaaagagatgcctactttaactctatgcaagtggctcatattcacgaagtctgtagatattattcatgtagagtgagaaaatcatcccagcggtgccagcacattctccttcccatgatctgcttagtttgcaaacatattcaggccatgggtgagagatttgtatttcacagtacaacaattttatggagggcattgaaacttacattgagcattttagtacagtcacacatcactgaatgatagggatacgttttaacagatgtattcgtaggcaattttaccattttgcaaacatcacagagagtattacaaacacctagattgtacagcctaccacgtttaggttatatggtatagcctctttctcccaggctacaaatctgtgcactacattactgtactgaatactgcaggcaataagaacacagtggtaagaggttatgtatctaaacataattaaacgtagaaaagtatgtaaaaatatctattataatctcatgggaccacttttgtatatgtaatccatctttgactaaaatgttattatgcatgacatgactctatgacaaaaataaaataacacattgtaaaaaaatatacacaggtatcaaacatattaatattgtaaaaataaaaatatttattcagtgtaagaattcgtaatgatcacaaaatgttcacagcttatattttagtacagtttcaaatgcctagtgcaattgctatttatttctgtattttaaacatgtatataataaatatttttcaggttcaacaatatatatcaatccaactggctcttataaatattagttaacatcaattggtaaattcatatatatatatacacacacgtgactcagtctgtatgcgtgtatgtgtgtgtaaatgtaactgtatgtgtgtgtaaatgtaactggatgcatcctaatatttacccttacctacaagatttccaagactcatttattctctttaaatggtgtgccttgaaagatttaccaaataaaaccgcaatcgtggaatatatcaagatgttattaaattcatcttgtgcacataattgtttctttaaatttatgtttcttgcaaaacttgcggtaatgctcatgcacaaaataattttctaaataaaaaataaaaacattttctcagtcattaattcttaaaaagtatttctccccagtaattaatgtgaattaattcttaattcttaattatagaataatgttgcccttcagagttctgaatcttttgcacgttgtatacagtttactgactggaacatcttctggaatattggcattaattaatctcactcagcaattaatgatttcaaagaaattaaataccattcatattctgaatcacaagggtactttggcatctaatttaatcaagctctttgtatcatcatctacactttaattacttaacaaacatttctctgtgtgagaaagattgagcaggttattgtgcttttttatgatgcaacttttgcttaatctagagataggcaatgctccctataagggacaaagagaaaaatgaaagagcaatagagatgtgacaggcatggaaaaagacaatacatttataaaacaaatagggccacagatgatgataatggggatcaaatcttgagatactgactcagtttataaacgcactgtacaatagagcaaatcatttgttaattattttacaaatggaatctaatttaactaagatgaatacagtgttttaaacaaggcaggtcatcttaaaataaaatagtgggaaaagtgataaaaccaatgtaaaaatcataaacattttataaagaatttttgtcatgtaatttaatatttttctttatttaaaatcacccaaatcaaaataattttatcttaattaacaaataatcatcggaagttaactaatttttactttataatactaggtttaaaaattcttcactatatttttaatcatacatgcttatacataaaatagacatagggtatatgtttacatgttcacaatattatattgtaattgttcttatggatgtggtttttcaatagaattaataagtacttttaaaaagtttcaatttcaatgatatatatgtttgatttttctttgacaaagcatacatatattgataggtaataataagaaaatcttctaaagacattacaggaacatgaataagtaattaaatcctcaataatttgtaacgttttatgtaagcggaacacatttaactgaaaattgcttttatataatactcaaacgagactaaaaacatattaactagcggagtaagtcttcaaattgataatctgaactataaaagaggagaaacttcaagcactcaaatatttgaaatgctacaaaatatttatataaactattatttaacaatttctgtttgtagagtgctatagagtaatcgatgtaaatgacatctcagtctttctatagctttgaccacatttacctcctaattttaattattaatatgttggagcagtgcatacaactagattccgatcttcctttttaatgagtaaaaatatgtcctttgagacagcattaaagaaagagcaccttgtataaattcaatgccaagagacaagatattcttgatgctgaagtcttgttcttttatacagcaatgtaattaataagaagaagaaaagcaggacatagagatggagtctattttcatcaaaaattgtctatagattttgatgataaaatttaaaactctactatatttagttagtcacaaaaaacgaggttgtgggaacatatttggtcaataaaacacccctaccaaaagccgacaagaaaaaaagttaagtaccacctttcttctctgcagatggcctgagatgggttaatttgaaagaatgcttccaaacctgaggtgacccctgagaacagcataatccactgctgtctcccacattcagtttctcagtctgtgctcttttaattttggggggagggaagccagtcctttaaagcgatcttcagcatgatggcagagccaaggagtgtggacaggtggcacggtgtctgattttgttccagcagccacttgggctttctctgggtcttctctgccctcgggatagcactactattgaaaacatgtctttgtgacattctctatgccaggaactcccaacatattttccttgaaactgatgaaatgaaaaaaaataaaccaagaggtgtgctgtttgtttctgtttcctcctttctgcagcccttcttgatcatctaatatttttaaatacattgtcgatcaccaaaaggagcataagggctttattggtttgtagcagatgtattcatagcccagcccctattccttagctgtagctgctgggaagaaaaccattcttaacactctacaaggtctcatctccagaatttgcaccagtttctagctgaggactttctctagcagcacgggagcttgttactgggcatgaagtgggaagaaaaggtgagggtaactaagaagaatctccctggattcagtgatgtaattctgaggcatgctccacatagcttcccataaaattaagcccagatatctaacacagggacttacttcttaacacgtgtggtattggcttttctgtctttcctgttttattttgttctcttttccttgtctcactttcgctgtgtcctcactcctgctttaagaatacccaaacaaatacgttcatttatttttttagactctcagaacacagttgatagttgaacttgtaatctatgataatcagcttggatgctgtattgacaggaagatggtgaactcacaatgtctaattaagatacaatttaaaaaatatattgaatcatgtccaaagacttaaaaagcctaagcggcagcgtcacagtttcttctttttagtttgcatggtttcttaaatgcctacaattattttaaaggaagccttgagtctaggaaaaattgagacatatggaataaattactaacccatttctccttgaaatccattagatgtttgatgattcttcacatatatttctgaactgaaaagctagttgggaattatttttataagcatatccttatgtaatatattggttctaagagtgaatggaaggtttaaagattaaattattctatccagagaataaaaaacaattatttcacaaggagaacatgtgtatgttgacacgacattttaaaatctagattttaaaataggtcccatataattttgagtcaattagaatacgtttgtatcagtctgtctacagttttacacctgtcaaatgttacttgaactaaaagaagtaccttgaacaattttgaaatttattattcctctgaaactgatgaaaagaatgacggtagagtgaaatttggattggcataatttaggagagaaattattccttggagatcaacctctgccaagatagtttacaatgacattgatactttttgatttacacaatttgttatataaaaaatactaagacgatgacagataatacacagactttaattaaaattgtactaaaattaaaagtctaaataaattacaagtgtacgtggtacacctaaacgtatgtttatatattttatttgtgcattttattcctagggttccttttgctttagtttgtaaaacgttcttatttttatggcagtgtagtatatactaaataaagaaaaatcaggaaatagaaaatgaagaagaaaacattagctattgtcaaccaaataaaaattgtgcaatctctaagtacatgaacgatgtattatttgtacagcatgtacaatgtttatgcttcacagggtgaggtagagactgcaaaacattgaacctgggacaaataagaaagaaaggaaattttcacaatatattaatattacagaaaatgttgaacttaacagttaagatacaagtagtgaaaaatgatagtatttaaggagatctagaaaatgtcatccataccagtaatgtgtgagaagtattagaataatgcttgtatttctggattggcatcgatttctattgagactggaaacatactagaagtgagcaaaaaagaatttaaatagtggatacttgagttttatacctaggaattcgagaaatacattttgttactgtcaaagcagttggcacaagagtgtacaaaattccctaattgtgtctatgtggtgaagacatagacaaacagaaaatagcaaaacagaaatagcaaaaaagcacaaataaattttacctgtattttttacgtaaaagccaattagagtaggaaaacatgaaatttgtgttttatcgaaatttttctcttatagtatagttgattatattactggaaaaaaattgaagcattggtatgttcacaaaaaaaagtaaaagataaggtcaaaaccatgggaatgcagggagcagacaaaatacacctaaacactgatactgattttgccctacggacatgtagcaaaatgaatgagtgcagattcctatggtcatacatcacataggacagtaaagaaatacatagtgtttcccaagatagggcatcacacaggagctcttccctaaagctagcaccaaaatttatctcctcagtataaagaagaatcagaggtaaattagtctcatttcacattccctggaaatggcaaataaaaatgacttgagattggacagatttaaagaaactcaatcattaatgatttacagcaattaatttaaaaattgtttaaatgtgctgtccaaacatacgtccaaacacctttaggccaagaattaatataatgtggtcccagaatggtggtgcctttagtagactcacaaaaaattcaaattctctttggcaaattttcttcttactaatatgcaaaagtgcacaataataattttcagagaaaaataaatctttgtcattcaaaggcatctaagtacgcaaggaaatgatattccaccatttgaaaggaaagcagaaaaagagtacaaacagatccacagaggttcattagtagaaatatcactgttagattataaagcacatttgctttcaaaaaatttaaaaaaaggaatatatttttaggagactaaaaagttgatgtagtaaatttgaaaagtagtttgtatatagtattttaaattaaaaactcaaaaatgaactcatcagattagacatggccatggtgagagctcataaatatttcagaatgcattacagaaaatttaaaaaaaggcacaatgtggacagaatcatgaagagacatggaagatacagtgagaaagtgtagcatgtgtttagtgagtgttctcatagaggaagggaacggggaagggacaatatgtgatggtattttggctgaaagttctctagagttttgtaagacactaatccacatattcaaaacttctatgcatgctaagcaagctacgatggagataaacctacatctacatatctcctagagaaatagtaaacaatcaggaagggaaaaatatttcaattagcactagaaaaatcaaattacctttaatcatattgaaatctgaaagcatgaaaggtaaaataaacaatattatttgttaagaataataatgccattctgaaattctcaaccaagaaaaatattcatcaacctatggctaaatcacatatttagagacaaaaaacaaaacaccaccagcagaattccactaaagaaactcaaaggaaactctgaaaacacgcttcagaaagattgaagttctgaaatcaaagaatgaacacagagcaaaatatattgtaaacataaagatagatcaaaatagaaaattaggtgttgaaacaaaagaatatttaaaattaggtaagcactgcaatatgtatgttaggaagcaaattattagggctgaagtattcaaagaccccttaattgtctgacaagagcagaaaggtatgactttgcaattcttttttttttttttttttttttttttttttgagaaggagtctcattcaccctttctcccaggctggagtatggtggcgtcatctccgctcactgcaacctctgcctcccaggttcaagcaattctcctgcctcagcctcctgagtagcggggattacagccgcgtgccaccctgcctggctaatttttgtatttttagtagagacggggtttcaccatgttgatcaggctagtctccaactcctgacctcgtgatccacacgcctcggcctcccgaagtgttgagattacaggcgtgagccactgcgcgcgaccgactttggaactttaataaattgactggacattatgcatttctctgttgtatctatgaaaacaataaaaataaaagtcataattttaaaacaagaagacagaaagtgataggagaaaatgagacattatatatatatatatatatatatatatatatatatatatatatacacacacaacaaattactaatacaaaattaagtataaatgatcaaagattaacttaaacctaagtagacaatgtttttgttaaaatacaaagattggcaaaatttaaaacatccatctctatcatagttacaagagacacagctaatatataaatttacagaaactttgaagttcaaacaatacagatactgtgtatatatgatatacatacaaacacactacatgaatataattttttaaaaagttgctatgtagaccaaatagaagttagaaacatttattaaaataagttagtgtaaccagtgtgataaaagttttaagttattaagaagatgtgatgacttcaatgtgtattagcctgatacatacatatatatatacacacaaaccacacactctctctcacacacacagacacacacgtatttagagagagagtcaaattatataaagcaaaaatatcagaaagtaagtagaaatggataagcccccaaatattatagacatttcaaacacacgtctttcagtaatagataaaagaaaaaattaaaagagtaagttttaaaagaagctagtggattttaaaacgggcaaatattatataaggaacttgaatattataattcatgttattttcatgttcatacagaatacttacaaaaattaacattttctagaccataccacaaattcaaacaattttcacggaaataacgtgacacagaatatatgtcctaaacaaacagcaatgaaggcagatatcaatacaaaaacgaaagttagaaacataagtgtaataatattggttggaagccattttattgaatattgaaatattttaaaggtgaatagtcactacaaataaaccaaacacttttgtgaggccactaagatgcatgtgtaatgtgtaatgcctccttttataaggagtaaatctgtaacatcacctgggctatttgacaactgcaaagtgaatgtgagaaggagagaaacagtgagagagagagagataaaagcagtaaaataaacataaagaatgaaggagatagccaggcgccattgttcacgcctgtaatcccagcactttgggaggccgaggcaggtgggtcacctgaggtcaggagttcgagaccagcctggtctaacatggtgaaacccactctctactaaatatacaaaaattagcctggcatggtggcatgcatctgtaaccccagctactcgggaggctgaggtgggagaattgcttgaacgtggggtgtggaagttgcagtgagtagagatcacgcgactgcactccagcttgggcgacagagcaagactccgtgtcataaaaaaaaaaaacaaaaaacaagaaagaaaaaaacgaggaaatagtacacgaaaaagcagaattaaagcaactgggtatatatttaaaaatgcaaaagctcactttttcagaaaaatattaaaatattaaatctaacaaatatctaggtagactgatggagaaaaatacagaaaatgcacaaaaaagcaattacctggaatgcgaacgttacaaaacgtcagcagttgtagattttaaataagcaatgatttttgagttcaaccatgatggggtatattgaaaagaatctctcagaaaaaaagaaaaagaaaactgttataaagctatgtacaaaatgttaagcactattaaagtcttccaaatctaccagttacggagttattggtcttggactaacactcctgaaaagaaaaaaaacaaacaaaataagacaatacctaaaaacctggataaaatggcctaccgtgggcactggcaatgcatccaagcaggtaggacctgggtgctacattctctttgtcagaacacaaagcattcatacactcttctcaccctcactttcaccttttaatctttgatctactattaaatgtattcaacattactatcaatcctttgctcaaaatttctttactcacattttgcttgatgcacttggatagactgttcaagaaagtgtgagtagtgaattcctcaaactcttgcatattcaaaatcacatttttgaacctcgatgcttgaagtgtagcttgggtaacagatgggctttaagccaattttggcatgcaaggggttgagtttattaggcatcagcaccgctgaaaatcgtggggatgcaggcttaatttcaacactattctaaatacttgaaagatattatataagtctttaataaactcctgtgtctacaaatggttcacattaactcaatatccatgatgaaacatctataaaatcaaggcactgttatttagtggagacttgctggctattctatgagaggaggtattgttattgtaatctcatcatctcataaaattgtatcatattactcataaccagcccttcatattctattcctattttggtattttaaaataagatatctttgaaattcttgaattcaaagagggaatctgaatactttttaaaatgtcaatgaaatgccatttcttcatgcttcaacaactaaaaattgactaaagtgcttctcttcaatctttctgggacattttttatctaaattctaagaacaatcacaataggttttaaccacaaatgtgagaatattctaaatgttagggtggaaaaaatttttaaatattttatagtaatttttttcatcatagtgacagtgtgctaaatttttttaagccaactattactgtagacatttaagtcaggattctaagaagctgttctaaagtccaaaattcagtttcatatacactgatattatatatatatttgcttaaaaaattaatacatgtgagccgtgtttcaaatagttgagagattattatatcaaagattcttgattatataaaatgccaattacttataggcagacatgctttaaataattactaaggcagttgtggttgattctactcttgctactggcatttatatggacatactattatggtctgaagaatatttaggcaaatttatccctcatatgatcagaagaacaatgcaagatagtttatatctgaaaggaaaaaaatctttatatggttctgaaagcgtaaatcattaacaacttggataataattagcataaaaatacacaaacatgccctcttcctagcagtaagtacacagtgacaacagaatcaaagcatgtggctatgtgcatgtttatatttcaagacgcagagcactctattcctcctctctgccctttctagatggcacaatccctcatgaatctaagtgcagtcatagggtggattagggtgacctgccatttgtatgcaactgatctctagtttggaagtaattaatgtcaaaatatatttttaaaaggtaatttcaaatttcagggcaaactagcatggtttcgccccttttctttggaacattttttctaaggttggaaaagtaaggtaggctttagtacgattttaaataataagttttcaaagtgagacgcaaaatggtggcgccaacacatttcaaatctgctacattttgaagacacttattggagaaaagaccttctcatcatttttctcttacaggaaaggaaataacacgtacggttgacccttaagcaacacggaggttggggtgctggaccccctgcacggtagaaaatacactataactttgactcccccaaaacttaactactaatagcctactgtaagcctgacaaataacacagtcaattaacacatatttaatatgttatatgtcttatatactgtattcttaacaaacatgccagagaaaagaaaaaagaaaatcataaggaaaatagatttactagttattaaatggaagtagatgatcaaacaggtcttcatcctcatctttctcatgggcaggatgtggataaggatgtagaattgttggttttgctaagtggacgtgcacagttcaaacccctgtggtgcaaaggccaactgtatagccattgaatagcaatttatatttagaaattaacctcactaaaatactcttagaaagatgcccagaaaaaaagtgaataagaatttttggttcatctattacatcatttcatttcattatttcatttcttttcatcatttcatttcatttcctcatttcatcctttcatttcatcatttcatcatttcatctcatttcctcatttcatcctttcatttcatcatttcatcatttcatctcatttcctcatttcatcatttcatttcatccttccatttcatcatttcatcttatcatttcatctcattttatcatttcatttcattctttcatttcatttcatcatttcatctcaacatttcatttcatcatttcacttcatctcatcatttcatctcatcatttcatttcatctcaccatttcatttcatctcatcatttcatttcatctcatcatttcatcttttcatctcatcatttcatcatttcatttcatcttttcatctcatttcatttcatcaattcatcatttcatctcatcatttcatctcatttcatttcacttcatttctttgtttcatttcatcatttcatttcatcacttcatctcgacatttcatttcgtcatttcactttatctcatttcatcttttcatctcatgatttcatttcatctcatttcatttcatctcatttcatttcatctcatcatttcatttcatcttttcatctcatcatttcatcatttcatctcatttcatcatttcatttcatttatttcatcattgcatcatttgacttcatgtcatcatttcatatcatttcatcatttcatgttttcattcaatcatttcatcatttcacttattcatttcatttcatcttttcatttcctcatcatttcatttcatcctttcatcatttcatctcatcatttcatcctttcatttcattatttcatttcataatttcttctcattgttgcattttgtcattccatcatttcatcatttcacttcatctcatcatttcatcatctcacgatttcatctcatttcatctcgtttcatcttttcatctcgtcatttcatttcatctcatcttttcatctcatttcatttgatcatttcatcaattcatcatttcatcatttcatttcattatttcatcatttaatcatttaacttcatttcatcacttcatttcatttcatcatttcatatcatttcttcatttcaccatttgatcttctcatttcatttcatcatttcatcatttcacttcatttcatttcatcatttcatttcctcatttcatttcaccatttcatttcctcatttcatttcatcattccatttcatcatttcattacatttcatcatttcatcatttcacttcatatcatttcatcatttcatctcatgatttcatttcatctcatttcatcatttcacttcattctttcatttcatttcatcatttcatctcaacatttcatttcatttcatcatttcacttcatctcatcatttcatcatctcatgatttcatctcatcatttcatctcatttcatcttttcatctcgtcattacatttcatcatttcatttcatcttttcatctcgtcatttcatttgatcatttcatcaattcatcatttcatcatttcatttcatttcattatttcatcatttaatcatttaacttcatttcctcatttcatttcatttcatcatttcatatcatttcttcatttcaccatttgatcttttcatttcatttcatcattccatttcatttcctcatttcatttcacaatttcatttcatcatttcatttcatcattccatttcatcacatttcatcatttcatcatttcacttcatctcatcatttcatcatctcacgatttcatttcatctcatttcatcttttcatctcgtcatttcatttcatcatttcatttcatctcatcttttcatctcatttcatttgatcatttcatcaattcatcatttcatcatttcatttcattatttcatcatttaatcattcaacttcatttcatcacttcatttcatcatttcatatcatttcttcatttcaccatttgatcttctcatttcatttcatcatttcatcatttcacttcatttcatcatttcatttcatttcctcatttcatttcaccatttcatttcatcatttcatttcatcattccatttcatcatttcattacatttcatcatttcatcatttcacttcatctcatcatttcatcatttcatctcatgatttcatttcatctcatttcatcatttcatttcattctttcatttcatttcatcatttcatctcaacatttcatttcatttcatcatttcatttcatctcatcatttcatcatttcacttcatctcatcatttcatcatctcatgatttcatttcatctcatgatttcatctcatttcatcttttcatctcgtcattacatttcatcatttcatttcatcttttcatctcgtcatttcatttgatcatttcatcaattcatcatttcatttcatttcattatttcatcatttaatcatttaacttcatttcctcatttcatttcatttcatcatttcatatcatttcttcacttcaccgtttgatcttttcatttcatttcatcattccatttcatttcctcatttcatttcacaatttcatttcatcatttcatttcatcattccatttcatcacatttcatcatttcatcatttcacttcatctcatcatatcatctttcattgcattatttcatttcatctcatcatttcatttcatcatttcacttcatctcatcatttcatcacatcatttcatttcatctcatcatttcatttcatcttttcgtctcctcatttcatttaatcatttcgtttcttttcaccttttcatctcatcatttcatttcatcaattcatcatttaatttcattttttcgtcatttcatcattcacttcatttcatttcatcatttcatacatttcctcaattcatcatttcatcttttcatttcatttcatcatttcatcatttcatttcatttcacttcattatttcatttcatttcatttcaccattttatgtcatcatttcatttttcatcattccatttcatcatttcatttcatttcatcatcatttcagctcattatttcatttcttcatttcatcatttcgtttcatttcatcatttcatcatttcatttcatcatttcatcatatcatttcatttcagtgatacatgtatttaattgctaatgcgatgcccaggagacaccctatttccctttctaaaacacctccttcaacaaaaggcaacttctcatggctggctaagtctacagggatagcagcctctcctcaaccacccaatttcatttaaaacctcaaacagcacctcagtttcataaaaacctaaaacataaacacaacacttggttgtaagtgagccgacagtttcttgtctctttctctgctcaaggcttaaggctgtgtctccccaactacattcagtggaagagaagatcccatggacaaataagtttgagaattgttgttgcaggaattctcagaactttcaaaacacaaatcttcatccgcagggatcttcaggagggagatggctgatgcagcacaactttctttcagaggagtatcttgcagaatacagtatgagatacagaaaggctgcattgagtctttttaatggcccgggccttggtgagggtggggtaggagctctccagatagcatctaatgagtaggaacattcaggtggcttttttttttccttattcgcaaaactgtgtgtacaccatgaatgaagctggtctcccttatccacgtcaaaactaaacctaaattaattggctaaattgggactcaacacctccaggagccacgcggcagaaagccccaacacactttaaattagcttgcctcatcatatttgaggaaagcaaaacgcttatgaccagtatgctgctaatacaagtctacagataatgctgtatgaaaaactagttttcccaatcatagctggcatagtccacattttgcattacactttccccccctttttttaaattttaaacacaggtctttttctcttctttttttcaattttaattaaattatacaagacggagtctcagtatgttgcccaggctggtcttcaactcctgagctcaagcgatacaaccgtctccgcctcccaaagtgctgagattgcaggcctgagacactgtgcctggccttaaacacaaatcttaattcattcttacaattattctgaggttacaaaaatggaaggggaagaaaaatggcaagtaggtaggctgacttcggcttcattatttggaaggacagtttgctcggttaaaacacactactgcctacaaaggccaagacaacagaaaaatacagacttacataaatagattttatatgtgacagcagtttgaatggagactttttcaatgcaatgagaaacagctgtgcttgggaataaatgacaacgaattttttttatctcaacagctgtcctgagagcatgtctctacatctctacctgcattctggaatcagggagaaagccaaaacggacggcaagacactagatcagccgtgtccaaccctttgcctacaaggacttttccacctatctgtggtggtgggtagcatgaaaattatgcacaaacctttttttttttttaaccccatcagctgttttagcattagtgtattttatgtgcggcccaggagcattcttcttccaatgtggccctgagaagccaaaagactggacacctgtgcactagatcaaaaggccactccttctggaagcaattgtaaagaatttctgacattatcttgacatgaaaaccaatgggtagtgggacagaatgcaaaatcttgaagaatttttcttgtcttttttttttttttttttgagtcacggtcttgctctgtggcccaggctggagtacactggtgagatcagagctcagtgcaggatcaagtgctcctcccgcctcagccacagtagtagctgggactacagatgcgcacaaccacccctggctaatattttattttttgtagagatggggtctcactatattgtccaggttggtctcaaactccttgactcaagggatccaggaaaggataacaggtgggagccaccacacctggctatgtgcatgaacttttaagacaaacacaaggccccacaaaagttaaggtttttcccacctaatttccagggggatcttttggtgcaaggctgagaagcccttaaaagtacacagacaactccaaagattcaagacagttcatttgggctgagccagcccactgggcagactgaccttccaaaaagacccacccatgacatacaccagatggctctccaagaatctcttcagtcctcagggtccctaacgtactggacagagctaggaaagcaaacccatttgcttcttcctgcaggaaaccccttgaggttaagaccccacaatcacatgaggatggagtggctcaccctcagtcaacaggccagactcaaggtggtataatgtcttaaccacgggtgcgggcctccaggtctgactcccaactcagttcttctttaataaccacactttgttaattttccttaacaggggttcctggcaagtcatttctccctcaggccttcggtttcctcacctacaagatgagagggctggaccagatggaaattcagggggtaaggggatgtcctcacgcagcccacccccacccccacgggaccctggagcctccatcccagttcccaccacgcacccgctccacaaatcctgcccaaggtgagggctggtcctgggtcctctggctgccgcatcagcgagtgcaggagggaggggaagcctccaagggggtgacgtgggctcaaagatgcaactcggccaggagtgaactggggccccgaaggaggtgtccgggccgctcctggagcccagcccgggtccccgaaccccttacctccagggtctgtatctcctgctgggtgaggtcgttggacacagcgcacttggtgcacagcccgcacaggctgccaatgaagatgacgatgagcttctggagctgcccgcactgctgcagcgcccggctggccgcagcccctgtgccaccctccgtggccgccgcatcacccccaccaccgccctccttcttctctcccatcgcctccacaggcagcgccactctatgcaggccacaggggcctaggcaaggagcctggggcgccggcgcctaggcaaggaatccctgagccaggagagctggaccaggagcacccctcagagctgcccttgccaggacgccagtagagctggcagccgagtctgccgctcccgccctcagagccgtggcggcggggacaaaaatcctcggcggcgggggcaaaacgccgcggcggcgaaaaagtcgctgcggcagggggacaaaaagccgtgacagcggggcgcaaaaagccgcggcgggtaaaaggccgtggcgagtaaaaagccgcgatggcaaaaagccgcggtgggcaaaaagccacggcggcggtggggcaaaaagcagcggcggtggcggaggggcaaaaagccgtggcagcgagggggcagaaagccgcggcggcaaaaagccaaggcggcgagtgtgcaaaaagctgtgtcggcggtggggcaaaaagccgcggcggcgggtgtgtggcagaaagccgcggcgggcaaaaagccgcggcggcgaggggggcaaaaatccgcggcgggcaaaaagccgcggcggcgcggggtaaaaagccgcggtgggcaagaagccgaggcggggtggaggcaaaaagccgcggcggcgggtggcaaaaagctgcggcgggtaaaaggccgcgggggcaggggggaaaagccacggcggggaaaaagccgcggcggcggggtgcgaaaagcggcggggggcaaaacgcctcggcgggcaaaaagccgaggcagggtgggggcaaaaagctgcggcggcgggtgggtggcagaaagccgcggcggtgaggggggcacaaagccgcggcgggcaaaaagccgaggaggggtgggggcaaaaagccgcggcgggcaaaaagccgaggaggggtgggggcaaaaagctgcggcgggtgaaaagtcgcgggggcaggggggaaaaatccacggcgggaaaaagcggcggcggcgagggggcaaaaagccgcggggtgccaaaagcggcggggtgcaaaaggcggcggggggcaaaaagccgcagcggcggggggcgggcaaaaagccgcggcgacaaaactcgcaacggcgaggggtcaaaaagccggggcggactaaaagccctggcgccggggcggcgggggcgcaaaaagccgcagcggcgggtgggggcagaaagccgcagcggcgatggggcaaaaagccacggcggcgggggtaaaaagtcgctgcgggcaaaaagtcgcggcggcggggacaaaaaggcgcggcgggcaaaaagccgtggcgcaggggggacaaaaagccgcggcggggggtggggaagccacggcgggcaaaaagccgcggcggcgaggggcacaaagccccggcgggcaaaaacccgaggcggggtggggtctaaaagccgcggcggctgggggtaaaaagccgaggcgggtaaaaagccgtgggggcaggggggaaaaagccacggcggcgggggggcaaaaagcggaggggggcaaaatgccgcagcagcgggggacaaaaagccgcggcggcaaaattcgcagcggcgaggggtcaaaaagccgcggcgggctaaaagccctggcgccggggggcacaaagcagcggcgggcaaaaagcctaggcggggtggggggaataagccgcggcggcggggggggcgggaaaaagccgcggcggcgggggggcgggaaaaagccgcggcggtggcggcggagggcgaaataatggagatggagtggaaggccggcacagcttggcattgctggagtgcgatgtgataggaaatgtgcagccaaagacaaaaagatgtaagtaggcttgactcattgaagctaagaacccagatgttatcttgagggtattaactaataagcagtttaaatcagaatggcacattctgatttgtttcttgtacgttcatatttggcaggcatagatactgtttgaagagagaaaagtcagtagagagaggtaacaaacttaaatatgtgccaagtctagaaacaagagaccagggggatagggacctttcaaaataaaatgcaagatttgaaaactgattggctgggggatgaggaaaaggcaggtctttaaggtccatccctgttttgctttaagttgttagggggtggttttatcacatgttgtagaatatgtcatttcagttttgaacatcttgagttaaattgtcctagcatatcttatgaatttgattttcttccctggaaagctaatatttcaaacacttaaagagtatatagatttccaacttgtatccagtttataaaactatctctaggctgctgatttcaggaggaggcttatgagtattctccttgcagagaatatatcaggagttaacagcagcttcaatatttgtggatgaccggttaactaagccacctcttagtgtctttagttgggaaatcttagctgaagatattcaataatgaaccaagagtgactaagaaattcaatatttaagtatatttcattgtaattaatttgaattgaagtagccatatacagctagtatttactatattgaacaatgcaaataagaggaaaaaattaataaccatctctaataccacaggccaaaatcctcatcaatttattctagctaaaggagttgatcagaagcagtagttgaaagcaccaactaaacccagctggggttagttcactgtcattctctcagaaccgtctcttctctgaacaaaacaagtacaagagttcattgtgaatctgcattctccttgcctattttaaggttttgatgttgacgcaaatttgtgaaatccctcctgtggtgtgatatttcgttttccttgctttgtgttaggacaagaatgcttcagctcttaatttaaaattatgtttctccctcctaggttgagtgaacttagaatgcattctctgacatatccaagattttgttaatatgaatttcgggaaaaaagcatacttaattagctaagacgtcttattctaagcttgaccctatgttcgacatcttttgaatttctggttgcgtgggctgctctctgacactggttagtgacctggaagctctattaatgttaggggaggtggtgtatgagcattagaggtatccttgcaaggaaagacttgtcttatctcaatacgtctttttttttgcacacaagaaagtcaatgtctgagtcttctaaaatcttcctatttccaaattgcagattatgattgattcctaaacaaagacctaatttttgactcagagacgtggcaagctagtgaatcaccgttataatttaacaatcttcaagataaaattatctctgatatttagattttgcccaattattaagatatttgggtgtttcgttaagaatggaaaactctagtctcttgagcagagactataaaggcctcagatgatcatttttaattttatgctcttttctttaacaccttcaacacagttggaagcagccgatattccgcagagttgttgtgttttttaaaccaaatgcatggttcagtggtagaaaactgggctgatccaagctgttttcagtaaacacttcatttcaggtgacccatttcgtattaaataatctctagatcctgtcttcgaaactaactagatcagataaactaccctggattttctctttttagggtctgagagctgcagtcacttttgtgaaaatgattacaatgacaagatagagttgtagatggggaaaatgttttgactaatttaagcatagtggtatttcatatgagaatttaagttacacacatttgaaaattataatggagtctcttggctgagctttaaaaagaaatagcgtttaggctaaaaagggaactgctacctctcctaaaatcagaaagatgttacagtaattctccattctctagaattatcaagaagcacctttgtgatgatttacttttgctcttgcgactgtgagcccgtgtagtcgtggaaccatcaattagaatggttgctttctgatcccaaagtcactcgttctgaaaacaatatttttcataaatttgaaagtgagaagttttgatcttgccattcccaagtaactctcttaataagaggcatcagcatgcttcagtgacagctgtcaccttccattgctgagagtcatctttgagttctctatttcactccctacactccaatttagctgcagttctcttggccagtcctatgaaatacatccatggcctaacaacttctcaccactactaccactcatgctgacagcattctcacctaagtcactaccttttttcactggattagagtagcctcccaatttatttgctcacataacctatttattctacacagtgcaccagatacacccctttgaaatgcaaacacaatcatattattctctggtgaaattatctcatatattcctatcgcatttaaaattaattcagaatcatcccatgattatcaaaaccctacatgctcttccacaacatggtttacttccaagatatctcttcaacatttttttcactgtactgaattggtgactaatagtcatatttttgtttttgctcaaaaagtcttgacttgtaaatttttcagtttctcctttatccacaggtaactctttcctgataaggcgaattgcttgcttccttgaattctgctctcaaagatacccttcactttctacctaatattaataactttaatcattcattattccattactatgctctatggtgtatacaatttctgttctttgtcatgttattaactaaattatttattgggtccagtaacgtattccataaatattgtacacataaaaattgtgttatttttattcctgtatgctgagctgcccaataacagtctgaggattaacatatttgttaaatgcacaaatacattctttcacaaatattagtttaataattttatattaaactccctctatacttacaatatgaattagataattcagaataaacattccattggaaaaagctacacaatttgttataaaacatccttaaaagcatcagaaaattaatacagcaatgaagaattacaggaccaaattaagaatggtatgaaagcctgtttgtgacgcttatgtttgggttatctctttatttgagtgactataaatctcaaaagagaactaaagggagaaataaccgtatctactaacatgctaagggtacttaaacatctcttagtaattgagaaaattgaaagaaaagaaaaaagagaaagggagaaagagaaacagcgaaagggataatgaaggagagaaagaagaagagaaaggaagaggaagaaaagtaaaaaggaggaggagggggaaggaagaaggcacaatcacagctcactgcagtctcgaccttccaggctcaaatgatcctcccacctcagcatcccaagtagctcacactacaggcacccaccaccacaccaagctaatttttattttttttgtagagatggagtctcactatattgcccaggctggtcttgaactactgtagtcaagtggtcctcccacctgagcctcccaaagtgctgggattacaagcataagccaccatacttggtgagatatgaatttctaggaaaaaaatcaaaattgactcaaaaagtagaaaaaaaacttacatagattaaatatattgaatcagtaatgaaaaaacttcccataaagaaatttccaggcccaagtgccttcaccaaaaagttccatgaaacatacaagagaaacaaaccaaccaaccaaacaacaacaacaaaaaaaactctgccaccaacacagagaataaaaaaagaagactcccgagttcattttacaaggttaaaataaaaataaccttgatatcaaaacccaacaaggcaagtgcaagagaaaatatttacaggccatcattattcaacgtggatcagcaattatttttaagatgtactggccaggtgtggtggtcatgcctataatcctagtattttgggaggcccgagtgagaggatggcctgagctcaggagtttgagaccagcctgggcaacaaggcaaaatcacgtctttataaaaaatacaaaaattagctgggcatggcagcacacctgtagacccagctattcgggaggctgaggtgggaggatcacttgagcctagcaggttgagaatgcagtgatccctgatcatgccactgtgctccagcctgggcaacagagtgagaccctgtctcaaaacaacaacagaaagatatgctgaccgcctgtgatgctggccaggatggcgtatgcatgctacggcctgtcatttccactgatcacaatttgaaactctggacaaaatataaatagcaatgacccaagtactctgaaaagtaaccagcagacaggttgggaaacgtcaaaacctgaagaattatctggatggtggtggtgagagatcatattctgggtcataaaacaaaccctaaagttaaacaattaaaattcagtgaattattttctctgatgacagaattaaactaggaatctagaacatttctagaacatccccaaatatgagaagttaaatggcatacttctaaatggcccataggtcaaagagagtatcttaagacaaattggaaaacagtttgaacttaataaatatgacatcatcttatcaaaatatgtgcttacagggcaatttatggcactaaattatgagaaatgaagcatcaaatcaataatgtaagcatttactttaagtaaaaaaagaaccaaataaactcaaatcaggcataagaaaaacagactaaatcagtaatatttaaacaaaaacagtaaaggaaaaaaattcaacgaaatccaaagttggttctttgcaagggcggtgggaggtggaagtcaatcaaatgaggaagcctctagcagactgacaaaggaagaagagaaaacacaaattgccaataccagaaatgaaaggaatattattacaaatcctgtagacactagaaggctagaatggacactacaaaaacaaaacaaacaactatatgcttctaaattctacaaattaggtgaaatagatcaattccttgaaagacagactaccgaaactcaagaagaaacagacagcttgaatacccctgtatttattaaagaaacagaagtggcacagcactttggaagacaatttggcaggttctgataaagtcaaacgtacatggaccatgtgactcggcaatcctacccttaggcatttgcacaagtgaaatgaaaacctatgctcagacaaaaagcactttgtgaattccaatccacttataatttatcaaaaagtgaaaatagtccatattcctccaatgacaaaccaataagcaaaccatgtagtatttatacaatggattactatttggcaattaaaaggaataactgttgatacagtatatgaaagtagccagactcaaaaggctacatcctgaacgattccatttgtataaaattctgaaaaaaaagcaatgccagaggaacacagatcagttattgccagaagtttacaatggaaggttttactataaagggtaaggtaatttttggagtgatcatataattttgtaatctaccaaaaacaaacataataaatgggcagataagtaaagttcatggattggaaagttcaatattgcaaagttctcccaaaaatgacctatcaatttaatcccagtggaaattccaatcagttttgtgaaggctgctaagtcaactctaaaatggccaagaatagacaagatcaccggagaggaagcagggaggtggacacaaatatcttctgattgatgagtgaaatcattagaaggccagcaaaaatacaagtaagccagaatttctaaagcaccacaaaagaacactagttagtagtgcataaaggtatctcctaaatttgttgtaaacataggcctttaaaaaaatattagaaactgatatttaaagagatataaactcatattaagcttttaaaaaattctaagcaagggcctcacctaatttcataaaaggttgcgtagaaccaaccattgctgcaaacgatgtgctgccctgagatgtgaggatcccagtggtccctctgggtcaacagcagctaccgcaggtgagcccaaattctgatacattatctatctacaatcattatttttaacaatgtatatcaatgctacccataaggcacagagaagcagaaatgtttatgtggcctcctgccaaaaacaatcacttgcacttatttctagtactccagaagacagtaatagaagtttttcaatttagaaaaacatttacagcaaagaaaaaaatctctgtaaacttcctgcttatccaatctagtgaattgtgatgagccatataaattcatttagccaccttatgaaagacttaatccaaagtcacttctaacttctagaagagctaatgtattataatcacagttgtgaaagactcaaaggccagaaatgtcaaggtgtggtctatatcctaagtccagaaaaaaaaacaaaaagcaacacgtacaggccaaatgattgccaatttcttctgcctacgtcatctttcttcactatagcctgaaattacatttcatgtttgacaattctcagcaaggagacaaaacaagcttatgagtaaaataatagaaagcagagccacagagaggacgagaggcaggagtcatctcccaagtccaagttcaacttctatattattagacaaggcctcagtgtctttgaactgcaaggaattaatattgattgtagcatgagtaaaatctatcttctactcatcatgaaaagtcacagtcgttttgtttaaagactccagaattattataggcagaaacaagcaggttccacacctatttggtgaaacgaggaatcaggaatgagcattcccaagagaatacaattacaaaagtaaaatcacctagagtttttgggctgcttaaaaaacccagaaagaagtgccaaatgggaaaataatcaaattcagtggaaaaactcacttgaaggtatcatggtcagctgggtttccacccctttgttgcacttcaaatcctgtgtattccacaaagacttgctcctttctaaaggctatggttcacattcaacagaatagcagcaaccaccatgagcctgagggctggctagtctttagtattctgccttattcaaagaaaggatcatttccctcattcctaaagatctcccaggtccatcacaaaaaaaaaaaggagcagcagccaggcgcaatggctcacacctgtaatcccagcactttgagaggccaaggggggagggtcacctgaggtcgagagttcaagaccagcctggccaacatgatgaaactaaaaatacaaaaatcagccgggtgtggtggtgtgtgcctgtaatcccagctactttggagctgggtaactggcagaggttgaacaatttgcaggtctcagaagacaggaaaatgtgggaaagtttgaaattccaagagacttgttgaatggctttgaccaaaatgctgataatgatatggacaatgaaatccatgctgaggcagtctctgatggagatgaggaacttgctgggaactggagcaaaggtgactcttgtcacctttgataagatggtggttgaggagaggtcttggcaagcagtgatgtgtgaatgtagtgaggggcctgaaaatggaactcagagaggacactgggttttagaggctgaaactacagaaagtccgctgcgttcaaggcctgcttccaccaaaatctagcagtgtggcctcaaaccatttcatttctcttggcctcagtttctacatctgcaaaatgggatttataatcccaccccagcccacagaattcagagttatatgagaaggctagaagagctcacctaccaagggactcttttaatggcaaggtggggaaactgaggcaccgagagggctagggctctgctagctgtcacccagagtctgatggacctgagatgagaaaccagaactcctgcccctagttcccccggctttcctcaggctggggagtgagtgcggtgagatagaaagggcaagccctcctgctgtttctctctggacaggggcgggatgctgggtgaagggtgaaaggaagaggctggagaagggagaaaagctccagctcacactaagtctgaattttttttaaatgcggactccgtggcccctcccttacccgccccaatcctctctgaagtcctggttgtgaggggccaagtcccaaagtctgctgctccgcctctctgtgtgcagagccatggggccttcacaggctgcagtgggtcccgagcccccagggctgtgcctgctggtcctgaccaagatcgcggctgccgaggtcagtccagcgccaagggcacagggccagggcaggcggggcagggctacccgaagcgcatagaggctgctggtgtcaacgtgacgtcttctggggcgcctggcatccctaggagtggaagccgctgatgaagtcaaagctgcctcctccttcaggaagactttgctcccatagctggcgaacaggaagcggagcagcgccaggaggatctgcgggcgctgctgagggcttctttgcagggacagtgcagcaggcagccagggacaagactgcacggcagcgccccatggccaggggaagctcagaaccggagtcgcccgctgcccggcgattctccatccctggatcggtacaggggcatttggacgctgtggggaagtcgcggtctggggatattgggtccagccttcgggtagaagcaggtgataaacgcactcaggccagcccggagcgtcagccacactgcggtgcccacgatgcccagggtgagcgccacgaggcgcaggaaattggctagggtgggagctcactggtaggcggccctggaagtcaaagatctgctgctccagcgctgccaccagttgcaggcagcagaaggcgaggagcgtgtggcacccgcgtactcgcccatcgctccgcggacctctttatccaaccttcaataattattctttttattatattcaatgattattctacttttcatagagagcagctgtcagtccaataacacacttaacaaatgatatacctagtcctcaaggttaacaaacacatgaagaccagcccaaccctgaaaatcagtttgcaaaccttcgctatatctgatgccattcctaaaaatttttagggacaagttttgtttgtggtaaacaacataaggtggggtgtgtgctgagcccaaagctgaccaattgctcacaattactcataactacccattgacttgattttatcaaacttcagacagtcttgtctcctctcctcaggcccctggaccttggctcaccacctaagactgaacaagcactaaaggacagaccagcccgctaacagctcactccaaaaatgagcgggactcccagagaaactatttttattggagcatcctggttttgccacctgctcaccccactgcctgttcttctctccaaggaggcttctgccagccctgcttgtccttccctagaaaaggaaagccttttcctgtttgatcctgagacacctgtagattgagtttggaatattctccctattgcaatagtatttttgaataagttttatttttccctacctctggttgatttttaattaataccagtaagcttggatgaaagcctgcacaccttaggtgtgtgtgtgtgtgtgtatgtatgtactttagcattatcataaagtaataacagtaaaatcaaacaaacacagatggataagcaatatgttggactagtatgaaaatggcattgccagcagtgatatgatttttttttcaaaatggtacactttttgaagtataatcttattttaacctaaaatcttactatcagaaaatgcagtgtacattaaaatgttctgaactgcttttattcatatattaaatggttgtactcaaatatctacaaatttgtttttcacttatgtaattgtcttatagaatgttcaaaagtcttgcagaatgtgagacaattttctattgaatacgatcgctttatcattgcaagacatcaaacatccctgtttcctgccaaataaatgtacaatagcaataaatgtaaagatgtgttttgtaaaaaagatatatttttgagttacaaaacaaggattttaaaacttgaattgttacagtgaatatgtcttaatacaggccagagtcatttaggtaaaaaattacctcatatctattctttacagtatcacttaaaggtgtttatttagcggcaaagatttttttttttttgtgcctagaggcagatattttgccccatggctatttacggtatgaaactgtatttaaatgagtgtacatacataaaagctgccattctggctgtaaactattgcaggttatcaagattaaaaaataaacaaataaaaatatttcagtttttctatgaaatgtctttactcgagtccaaatgtagagatataaaatgcttgaaattcataaaaccaagtgtttcacatatttcagttgtgatggcctttgtcctacttttgttagtgaagcaggcagactgcattttttccctctcatacatcttcaaatggtagacagaaaaatttgataaaacttctagggcattatctgatgaaacacattaaacactaaaggagaaatacaacttcattgtttataaaagacgtataagaaggaaacctgcatacatatatctatcagttttgtattttcaagaaatatttgccttaaaatgaacttcattagaatatgtgttctcccacagagccaaggaaagtaagttagacacaggatctggaagtctacctgtgtgatgtaattacattgaaaacattccacaaataatgcagaaatgtatcattgtgacccaaaatattctctaaattttctcaaagcaatgtggccacatctattatcttttactatgactagtcatcattccatgcatttgaacattacctcacccatttgcagcctcctatctctgcaattaattatggctaacattctcagcagtccaaacatcttgcaagtgacagcttgaaaaggcctaccagaatgatgttcactctgccacctgactagcttgtcttccatctagacattgcagtatgtagaagagtgcttttagtattataaatttgatccaacacgtgttcaattagatgaaatcttaaatactgcactacatgtgaattgggaaaatgttaatttgcttctgtagttttaagtgtattctcagaggcagatgaagacatattacatcactgagttcaagaaataaagtaaatagaagaaaaaaggtgttattttagtttggttatgtttatatttgaagttttcttatcataccttattttttgtttattaattccagggtagagtagaaaaatatgctctcatataatataaaaatgatatggggaaaagaagtaaaaaattaacttagagacaccattaattaatttcttttataaatgaaacactagatagtttctatttgttttgacaaatagataatatatttagaatcaatgctttatttcttggaaagtggagtgaaaaatttaaatgtagtattcagattgtattataactgtgcactacagatcacatacatttgtcttttctttgtattatacattatttaatggtaagcatcctttcaagggctattttatataagtagtaaggtatctggaatttctgaaataataaaagtgacctaaatcactgtgtttggtaaattcacaatacccaaatagcaggaggggagtgctagaggtagggaggagaatgctcatgttctcattattcccaaacagattcttaaagtcttctcactggacacatggatgcacctctgtaatacccaatgtcttagccacaactgtccgcactttttaatgagatacatttcaacattattccttgtcacctcaatatcagatactttctcatgtaatcttttacttctgaggagttgaattcttgatccataaactgaatccatagctatgcatctgtggatgtttttaaattatgtgaaaattttgtatatgcatttttcaggggaaagtatcagatcacccacctggtgattgtaacaaaaacaatcactcctgttggtatttaagtcttaattaattcagaaaaatttgcacacaccctaaggtcagatagtattttgtaccctacatataaaaactccttttttttttttttgagatggagtctcactctgttgcccaggttggagtgcactggcatgatctctgctcactgcaaactctgcctcccataacattaatgatcactgatcacagatcaccgtaacgaatataataataaggaaatattttaaaaattgtgaagattaccaaagtgtgaaaccaagacacaaagtgagcacaggctgtttgttaaatggcaccaatagacttgcttcaccagggttgtcacaaacatctcatttgtaaataaagaaaaaatgttcctatctgtgaagcacaataaagagaagtgcaataaaatatgtttgtattaatttggttaactttattccaacttaatgtaaattagttttaaaacagtttataaaattcttaaatgaacctggcaaatttagagcaataataaaattatttaaattagaaaagtcttttttaaaaaggataaataacaaatgtctcattggaattattaaagttgtttcaagttcagctctgaggttcttagaaactaaagtaaaaaagtatgaccagtttctgaagtcaagataaaatcatacaatctttaacttagaaaattatcttctgtgttgtgtcctaagcataaacaaatgtaaggacttgccctgacactctgtaagtagttccactccaatacgccctgcagaaatatttcctggcaagaacagcaagtcagaagccttttcagcatggcaaggagggagagagactatgctattaaaaaaaaaaaaaaaaaaaagatgaggaggaacaatagcaccttagacaagtgagaagtttcaaaagagacatataaggagagcagttgcaattataaggagcaaaatatggaatgatgaaaaaaagatactttaaagaaagttttcctcagtactttgcaatgcgcttgccaccttctgaagaaagctggctccttctggaaccttagggtatttggactcatgctttggaatggggtgaccatctacatcaagctaacttaaattcaaatttgtgtgcataggataagaataattgggttaaataaaattcacttttaatctaaaatgtcattcattagttttgaccaactttccttaccactggccacttggtccttgtcttgtttgaccagggttgtcaaacaaggtttgttgtttccttctttgaaggaaagagtcagtgtttcttccattccaatgcatccacttgaggaatttttaataaaatgggcaatgaatgggcagcagaagaagttacaggcctgctgatcaaatgctaagtaataaaccctggaaattctaaactcgtttgcatgaagaccttgcttattttgtaactattatgtattatcaaatgtatacttaattctttgaatgtgttagtatgtgttcaaagtacaccttaattttatatatatatatatttaaattacataaaataaataagccactaaaaatttttaaacattttcttatatttcctttcagtatttttatgtgcatgcatctgtacttggtaatattgctgaatgcatgtttgcattgacaaagcctctccccttgcccaaactctagttgggatcctctaagccacctctcagcctcagctttcagtgttcatcctagtctggcccacatctctcaggtttaggaagaaacttgcaaagaatcccccactctcagtactgatcacctttgatatctgatcaaatttgttatctcccaccaccctccagatgatttctgatcagtctggcctgccttcagtaagaatcctgttcgatctgtttaacccaaatcccctttgcccctgatatttcctcttagtatccccagttgagccaattttcaaccattaaaaaaatcttggacaaaattaagttcagataggttccagagtgcttatgttcagttcttggctttttgaagacctggcatatcctctttaaattgcctcaatacaagaaaatacaaaatggaaagaagtagacattagaaattggaaaaatggagaaatacaggaatgaacataagtttctatttcaagtaattaggtaaattgtaagatgtttatatttaactttttctcattggctttagccccttgaatctttgagaacatgttattactatagttatcgaatgttatattttttattttaacgtagaatggtattttcactcaaatctcttgaaacatatatttatagtcaatagttaaattttatttaatatcaattgttcctttttattagtattttcttaaaaaaataatattggcccagcgcagtggttcacacctgtaatcccagcactttgggaggctaaggtgggcagatcacttgaggtcgggagttggagaccagcctgagcaacttggagacaacctttctctactaaaaatacaaaaattagccggacgtggtggtgcatgcctgtaatcccagctactcaggaggctcgaggcaagagaattgcttgaacctgggaggtagaggttgcagtgagccgagatcgcaccaccgcactctagcctgggtgacagagcgagactccatctcaaaaaaaaagaaagaaagaaaatgccagacatttattgaagggctggaatggtatagtgaagtgttctgagtcagttgggctctgattgataaagagcttggcatgtttgaaggacagcaaggaagccagaatagctggagcatagcagcagggagacaagtgccacaagatgagctggagaaaggcactgggaaaggtttgtcttttaagtgctctgagaagcaattgaagatttgaaatagaatagtgacttgcttgatcacatttgtacttttgaaaagttcctctggctgctgtggggaaaggcttgagtagatgcagggtgggagaagcataaccagcagtagactcttgtagcaggttaggtgagagatggtggtggccacgagtgggctgctagtggtggaagtgacaagaagcagaaggatcggagacaaaacttgaagataaaaagtcttgaatttgctgatgatttgcattgacgaggtgttgggggagaggactgaaggagcagaggagagtgacaagggactggatgccatttataaggatggggaagactgggatgaaaccggttaagggagaaattttaaccatggcaaaattaagaggggttttatgtgagaaaatggaaatgctaaggaggaagttgaaaatcctgctaatttggagatctttgattaaaactagaaataagaatgtgggaagcatcaacttgcaagatgccctcattgtagataacaccatttaggatctaggctcaagccctgggaaactccagggctttggaagtcaaatagaggaagaacacgtacaggagatgaagaaagattagcgaggaagtcagtgaaatatccacaggtgggctgctgccaaatccagcagaacagtatgccagatgttaggagcatgagtaaaatgagaaaagagaaatggcttttgacaacacttccctactaatagtagggaagaagacataggtacagattcaagttgatttgaaattatgaaagtgaggtaattgacctgcagtggttgctgctcagtgaaatcagcatagtgattacctgagctaggttagagatttgatgggtaagaaagaacacctgagggtaatcctggagggggaaaaaaataaagtgtttgctggagagaatgagttggattgctggacttcaatgtgtgtgggttgagtttgtgacttaaaaatgaaaccagtctattgcttgtgtggcttttccaaaataccgttattccgttacctatctcttaccccaagagtagtcacattcttatttctggttattttaattcctggtggtatttttatgtgattaatgagatagtacttgttaatttgatgatattctagaaacctggtaagtactatgtaccttgtcttaagttttggttacttgattggtaaaattatgcatgcaccattgaattacctaattcaaaatatatccttttattgtttgacatttgtcttgtttttctttaaaatgttatctttgtggagtaaacatttttctttatgctgtttagcatcttcagattagttcagggtattgctgaatgtggttgtttggaagtaaaatgctttagttttagttatatagattttaataagatactactttctatataatttatcaggtactttaggcattttaatttgcaaatttaggacaatttgctttaacgtttcttcacttttgtccattggatgtaatttccataaagtattcatttccctgagtaaaaaccgaaaccaaaccggcaactaatggtcactgaagaaagagtgattaaatgctaagattataatggtatttgcattttaatgttaccagctctctacagtgtaaagtttatgcatttatctattgcttatgtttctcattgcattctttggcctactggttttggttgtttatagctatagaatatagaattccttatggttatccatttctccttttaagtagagtgatagttgttagaagaaaaataaccccccaatactttcttctagtgttaattcttaaagtgtgattgacttttatttactttttggtgcagtaattgcagttcatgagtcaatgttgatgtcatataaaccttaatttttaatgtttcattgtagtgatgtctctgtagcagcaaacatttaagttatttgttatacttaaatgtttaaatcactgttagtgattagcttattttgccttccttgaagcaatttgtcctaaatttccatatgtttgcatttgtttttgctgttctaaaattccttagttgctggctttgaccttttatgttgctgagttttacacatctattttctcaactgccatatcctaggaggcttggagtacccataatacagtgagcccaccttcctggtccccagacatttcaggaggtcgggaaatttttaaacccaggcagcttcctggcagtgccatttggagcatcaaagtggtaaataaaattgcatttacattcatatatcatttctgtctgatttgttttgccctactgggtgtaaagaattaaatctttcttttctagattgagcttccagaaacactttttaaatctaaaaattttaatgtaaagaaataatatgcttgcatttaaaaatcaatatacatttttaatacctctttttatggttaattccttttgttgtgattactaccggttttatgagggagaagtccttgacatgtagaccaaaaggtaattaaggaccttttcattcatgatatcataaaactttgttgcttagaaaaaagcaaaagaaaaaactccattaatttattatgttcttatggagaagaaataccaaaattgtggcagatttcattgtctgtttaataccttaaaatgacaaggctttttcccccatgacattggttgatggctgtgccagtccttgaagtgagttaagtagtgtgatgcattttgaagagaaaaaaattaatttgaaaaagtattaactcaaaagttaaaatacttcattgactggagatgacagtttttcttcatattctatatttaatattctggaatatggctgtttaattcagactaatcaaggattttaaggaattctagattatactttattttctttcatgactggaagtactatttttttttaacctccctacctccccctgatatcatccaagatattgaggtataaatatacctcatttgacagtttgataatatagaccaccaatttttacttaccttttttctgggtcagcatttcatgtttgagaaaagaaattgagagattactgtagtcttgatttttaatcactgacttaatttttcaaaaatcttttataccagcttaataacaaaacaaactcggccgggcgcagtggctcacgcctgtaatcccagcactttgggaggctgagggggcagatcaccggaggtcaggagttcgaggccaacctggccaaagtggtgaaaccccgtctctactaaaaatacaaagagatttagccgtgcgtggtggcatgtgcctgtaatcccagctgctagggaggctgaggcaggagaattgcttgaacccaggagatggaggttgcagtgagccaagatcacatcattgcactccagcctgggcaaagaagcgagactccatctcaaaaacaaacaaacaaacaaaaaacccaaaaaactaacctgaccccatctatctgttgtgcaaagaagctgatgcacttctcaaaagggatctcaaggagagcagggtaagagaagacaggagtggcagtttgaaactgggagctggctgtatttattacatccaaagggaaaaaagccattcctcccattccttttgttcatgtgtttctattttatgcttacagtatcatcataaatttttgacttggaaaccattctgctaaatagggaatcagtttatttcaaactatgataagggacatcagttgaagatatgacatattatttaacttatggtgagggaaacacctaagtattttcctgagcatctggataattttaaatacacataattcatctacttaggtaggtgccaggttttttcaaggagtaattaattagtacgaacaagggtgagggggcagggaacaccatactctggtacttaatgtctgaaattatcagggaatttaacacattttcccataggtttatttcttgtgtaagaagtcagataaattatttccatttcaagtatttattattcagattatttaaagcaaagctttcacaaagccttttgtcagctttcctgtaatcctcaaataatttttcctggctggacgctttggcttactcctgtaatcctggcactttgggaggcagaagcaggaggatcacttgagcccaagagttctaggctgcagtgagctgtgatcacaccactgcactccaacctgagtgacggatcaagttcttgtctcaaaaataaaagtaataacaataataataaattttcctctaaatacaatggtgaatgaggtagaaatgttgagttcataagagaactgttgaatagtgaaggaaactgacttaattttaatgacaggaagaatactgttacacactagcaaaaataaactttcatgctgatgtagcagtacagaatatgcttccaacccagggacgctggagccaggcttgctagctaagcgaccttggacaagttacttaaccattttattcctcagcacactcatctcaaacgaggataataaaacctactatatgggattgttgagagtaaaaaatacttagattagtacatagtaagtactcaatagatgttagctattactgtaatcaccgcgagaccagttaatgagagagttcttccttatccttactctatattgaatacaatttgttgcacttcgaaatatctggataaggctatagttgttgtcgtcaccgagaatgtaggagtggcaaagagaaaaatcatgcaaaggcttgctgatagcgttcacagtgacagcccgaaagtatgattctaaggttgtaagcattttatatttagaattttaagttgtggaatatacttttaaagataaaaataataagccaggtctcttaatacttatctaaagaagtgtttgtataacatttaataaaatgttttatctcagtggcatttggatttaaaaattattttgggctgtcacagaatgttgacttttcctaatctgttacatagggccatgggtctggatttccaggaaagcggagacctcgaggtgcaggactgtcggggcgaggtggccgaggcaggtcaaagctgaaaagtggaatcggagctgttgtattgcctggggtgaggcttgcttcatgtatattttctctaatctaaatgtcagttaatgatgaaaatctcatagcaagttattttgaacttaaaaatcatataaataggtcaaaatgtttattttactgtcctactttgctttttttttttttttttgagcctctggttacgttttcttgtatatttactttctcatcctttctcttttcttaccttcctctttgactccttatctttctatgccaaccctctctaaaaagtcagtatgtaatatagttgctcttttatttaaaaaattttaagattgatatttgcttactatcatgttacgaggctttatttatatgtgtattacaaatatatttgttaactactagcaaatattttatgtaataacttcgctattttattaaaatcctgtttttaaaattctgaaatgtcattttaagtataggagacaggtgaaattgttcaagtttactactaaaccaggaataaggaagcttagattcttgtccttttttcaaaaagaaaaattttaaaaccaggcttattgaggtatagttgatataagctatatttgacatgtacaattccataagctttgatatatacatatacacccttgaaaacgataccacaatcatgatagtgaatatattcatctcccaacgtttcttcatgtccctctgtaattttctgcattccccctgccatccgtccttgtccccaagattagtttgcattttctagagttgtatataagtggaatcatacagaactgtgtgctttttggactgatttatttcagcacaattatttggagattaatctatgctgttgtacttgttaacagtgtacttccttttcttgctgaatattaataaaactgtggatgcaccacggttgtagacctgtgcactttttttcttctttttttttttttttttttttctgagacaggttctcgttctaattcctggctggagtgcagtggtgcgatcatagctaactccagctttgacctcccacctctgtctcacaagtagctgggaccatagctgtgtgccaacacacccaactacttttttaaaatttttaatagagacagcatctcactatgttgtccaggctggtctcgaacttctgagctcaagcaattttcccaccttggcttcccaaaatgctgggattacaggcgtgagtcaccatgccccagcctgtagtcttaatttcttgtaatgtcttcatctggttttggtatcagcataactccagcttcatagaatgaatcagaaagtatattctcatcttcagttttctggaaaagttgtgtagtagtggaaatgtatcttcttatattatacatgaatttattagtgaaaccatcttggcctgaaattttctttgtggggggtttttgttgtgttttctttttttttttcttctttcttttgagatggagtttcgctcttgttgcctaggctggagtgcaatggcacaatctcagctcatgcaaccactgcctcccaggttcaagtgattcccctgcctcagccccctgggtagctgggattacatgtgcctgccaccatgcctggctatttttttttttttttttttttttgtatttttagtagagacagtttttcaccatgttggccaggctggtctcgaactcctgacctcatgtgatccacctgccttggcctcccaaagtgttgggattacaggcatgagccaccatgcccaggctggagtgcagtggcgtgatctctgctcactacagcctccacctcccaggttcaagcaattctcctgcctcagccttctgagtagctgggattactggcatgcaccaacatgcctagctaatttttgtgttttgggtagagatggggtttcgccatgttggccaggctggtctcgaactcctgacctcaggtgatccatctcccaaagtgctaggattatgggatgagccactggtgcccagcctgtgggacagtttttaacaacaaattttatttctttaataggtacctatttaggttatctgtctctccttgcataaatttgcacctttcaagaaatttgttcattttgtctatcttgacaaattaaaggaatggagttgatcataatgtttcttattattttaatacctgtagaatctgtagtgatttcaccttcctcattcttgatactaataatttgtatcttgtcttatttttttcctgatcagtctggctagagatttatcaatcttattgatcttcttgagtcagcctttgttttcatggacttttctctattttctttcccctttctgttttattgatttatattctcatctttattttttcctatcttctcactttgagtttagtttgatcttctttttttgtttactcttacgtgtccctgcttggaagggacacttgtgaagtttaggtcagagctttctattctccttggcttatatctgtggtctaggaaaatgaaatttctatcaccttctggataaatcacactattatctatgcaggcaacaatagcacatattttctgaaagattacctttgccctcaagttaggttttatttttctagcagtctaaaggtcatgaaataaattataaaataaaaacagtgggtcttcaagctagaggatactgttttctttcttgcatggacaattattttaaaatattttggtttttctgcacttattatttaaatatgactccccacccccacttgaatctagggacattgtagttttctactgcagactttgtttctggtttatactgggaatatattgtttatcattttcagtgaaagcatccactggttaaatttccttttaaaaataataatggatctttacaatttctttgagctgctcagtgtgtataatgtgttgaattttctgttagtggttgggaggtagaaatagatactttatctctattttagccatttccataattatatatctcaataaccttgtcaatgcatcattagtcctatgactgaattaatgattacttttagtagtcacttagtttcttactggtgatgatgattctacttttgtgaatcatctttgatgattctctaaaatcttagaaagctaattttgttaatgctatgcatacaacacatcaatacattttctctattaaaaaaattaaagcgttataggtagatcagaatttaccattactaactcctcaagtcctccttatttccctgttaccagtttggtatatttatatattaggttgatccatatgaaattgccaatattatttctgaactgatgaaaagcagcaatttcttatgattcaacctattatatgtgcccatagactacatataatgactttgcatgtttttatattatagtgctatacctcaaatactgttctgcaatttattttttcatcaacaacgtcttttgataatttctttcatggcagtctatacaagtttctacctccctacttttaaaatgttgcgtaattttctaatgtttggatttgtcatggctttacttactccctaatgatgaatattggcattattaacacttgtagtcattagggttcatatgaatataaattgctcttataaagcattagtactatccattaaaactgcttttaggctgggcacggtggctcatgcctgtaatcccagcacttcgggaggccgaggtgggtggatcgtgaggtctggagatcgagaccatcctggctaacatggtgaagccccatctctactaaaaatacaaaaaattagctgggcatggtggcaggcgcctgtagtcccagctactcgggaggctgaggcaggagaatgccgtgaagacagagcttgcagtgagctgagattgtgccactgcactccagcctgggtgacatagcgagactccatctcaaaaacaaacaaacaaaaaaacaaacaaacaaaaaaaactgcttttaaatgtatttgtattgaaaaatactgagatatagtccttctatttagttaaccaaccaaccttccttccttcctctttttttttttttttttttttttgagacagggtctccctctgtcacccaggctggagtgcagtggcgtaatcttggctcactgtaacctctgcctcctgggttcaagtgattctcctgcctcagcctcctgagtagctgagactacaggcgtgtgccaccacgctcggctgttttttgtatttttggtagagacaggatttcaccatgttgcccaggctggtctcgaactcctgagctcaagcgatccacacactttagcctctcaaagtgctaagattataggcatgagccaccacacccagctggttaatctttcagttgttcctcaagaaaagtaattcagtcgttttatgttttgaccttgaacataacctgttgtgtttcaactctgtctttccaggcttcggttgtaagctttttaaagaaagaggattgtattttatgattttggcagtgccctccttgtcttcttctacaacttctagttcagagctttattttgtttcatatcactctagaaattattaacaaaccagtggctacttagttgatttagtcaaatagaactaagtccagactgaacaatattggttgataatcatttggctgatactgaaatttggatgttattcaaaataatattctaaagcggtgctaatagaaatataatgagaaccacatatgcaatttaaaacttcctagtagccacattaaaaagttacagtgagctgggtgcagtggatcatttgaggtcaggagttaagagaccagcctgaccaatatggtgaaaccccgtctctactaaaaatacagaaattagctgggcatggtggtggacaactgtaatcccagctacttgggaggctgagtcagggagaacagcttgaaccaggaggcagaggttgcaacgagccgagatcgcgccattacactccagcctggtcaacaagagtgaaactcctctcgaaacaaaataaaggttatagtgaacaggcgaaattaattttaatgccttccattttgaccgatatatctaaaatattaccatttcaacatgtaatatgtaattatgtgctgtattttatgtttgcaggacatctcagttcagactaactacattgcagatcccaagtgtgtgtcattaaaatagtgatagatttgtggtgtacatacctataatattatcatttatagtttcttgattagaattctgcataatcaagtcttactaagacaggtttattatattttctcattacttcttggtccaaaggaattctacctctaaagagagaatgagttgaataataaaatgtcatgactccattttgctgtagtatcttagcattaatatttggaattgttattctagaccttagcaaaaatatatgttttgattatgaattttctgaagctttccagttaagtgtaaaacaagtgaaaaatataacttcgtattttgtgtattttgctttttataggtgtctactgcagatatttcatcaaataaggatgatgaagaaaactctgtgctcgatatggttgtgttgttttctagcagtgacaaattcactttgaatcaggtttgaacttgacaatttactgtcttcctcattgaattcctccttgcacatttctgctttatctcatatacacagaagtgatccaatatttagctatagagctatattagttaagaaggtatttttaaagtaaaatttgtaggtttttagcttagtctccatttaaaatatgttctgttttcttaacttcaggatacatgtgtagtttgtggcagttttggccaaggagcagaaggaagattacttgcctgttctcagtgtggtcagtgttaccatccatactgtgtcagtattaaggtaaacatccttaaactgagttaacaaatatgtattgaatttttatttggttttagtagtaacatgagctcccagttctcacaattaagtattatgattattaaacatatgtgacagtatttaagtactttaaatactgcttttaagggtttcctatctcaagaaatttgctcctctataaatcttatattgtactaatatcctgcttttgtcttgaaaaagtaaaacataaaaatatatgcatttaatttaaaagacaatttatactattcacaaagattttaggtttagctgattcattttgtctgttgacttataaagctgagaactggagtatttagtaaaaaattattatcccattctgttctttcccacattctgtctcctctgtgctcactcatatacaaaatgacattttctccttatagccaaaagaaagaaaacaagtgtcatatttaatgcaatcggtaataatcgagagtcagcactgctcactttcaagcatttcaggatagaggctttctggggaaccttttaagtggtatcgtgtgcttggttttaaatatggacaggtctcaatacttcactagttgtatctaaggttcttggttttttctttttaagaactcagtcttaataaaacttacatatttgaataaagtgtcatggccactggaagcaagcatggaggtatagctgtacagcagaggtcttaaactgtatactccacaaggaaatcttttctagtattgccataccatgtaatataaatactaacctcagtttcaataataggttgtgaaccatgagtgatttttataccattctcccctgcccttcagacatcactgtgttatatcattgtcagtaaaatgtcagtatagtaagcaaatcaacattatctccttcagaattctttgttgataactacactagtatttattttatagggtaatacaggtttttgtgaatttaggaatcaaaatgaaagattgtaattaatactatccaaaatagaagactagtacggttaatttctgtagttttttaaaattagttgctcatgctatgtgactgaaaaacacagagtatataaagccaattaaaaatggagttatatatgcataaaacatgtttcttttcttctttgtactttatattctgtataaaagtagctgctatcattagattttgttttttagaatgcttaatgttttggacctaaggaaattgaataagatccctttcaagatagtaatgtatttcttttaacccatccaacaattaccgaattcccattttacagatgagtacgacttacataagttaagattggacaattagtgcactatcagacacctagttattcctgtttttaaaaattatgtgtggttccttttacatgacactgttttggacagtatagaatactgcagtctcattgagaaatacagcagtatctagaaatatactagggatatatgaattggctcagcttgcatttttattgcaggaggcaattgtttgtggataagtttgatacctttgaagcttctttttaagcttgctggggcaagtctagaaagccttcactctaaggtggatattttcaaactttatggttttagaaccttaacactctttaaaattactggggacgccatagtttttgttcatgaggattttaactatggactattcagcattttagaaattaaaactaggaacattttgtaacacaagactacagaagcacaacctgtacaatgtcaatgtaatattatgatacaacatgtagcttctataaacaccactgtataattgtgaataaattaaagtgaaaaaaggcaaattaaatcttagtattatttaaacttgttttaactttacagacccactggggttccctagtccacattttggtagctgcagtcctagcattagtttaaccctatacttaagacttggcctttctgggatcactactgaattctaccccctgttcaccagtgtctttgtactctgactggttgtgcttcacttgtctttgagccttttgcaagctctggtaattgtgcagcttacacattcccagtagatgtactttcccctggttgtgggtctttgggcttctagaagtacggcttggtgttccaccaaagacttcaggggatcctttgtagatttctggagctcttagtccttattgcttcttcattttgagtactgtgtcctgcaaattccactgcctcgcctcccctaacctcagcgaggccattgattgtactctgctgaggttctccctccctgggcagcattctggaaaatgtttctaggcagaatatcataggactccctgagtgtttccttcctctcagagaccactgtctcctttactatgtgttgtccaatatctgaaaacagttgtttcatacactttgtccaattttctactatcttatgggaaaacaggctggtcccatatactccattatcgttgaagcatgtatccgtattagattataaaacatatctgtaacaactttggacatggtaccatggatggaatcctggatgacatcttatttgaaaaaacttttaaaactaaggctaaactggttcaatggaagaaaaaaatgatagtacaaccccagtacctaagttaaaaggaaatttcaaagacagagaaattgttgaagtgttgaagtactagaagtcaagaaacacaaacactaatgtttccattagatttgagaataagaaggtcttgacaagcctggcttaagcagttatgagtggatgtgggtgtagagaccagactgtagtgttttgaagagtgaatataagcggagaaacttgagagtttggttgtaaaagggaccacaggtatctgtgaagaaaacttagtaggaatgaagataaatattttaaaaattctgccactaaacacctcagatctgtctgccactttgtcttcaggtcattgtttaagccagggtcaggcagactggcccatagactaaatctggcccatttcctgtgtttgcaaataaacttttattgaaatatggccaagttcttttgtttacatatatttgtagcggtttttgcattacactggcagagtttttgtaaagttgcaacagatcatatggccctcaaaactttctgtttactctctggccctttattggaaatgtttgctggctactgctctaagccaccctgatcttaccccaggccatttccttcatttgggcaaataatatactaacttggtaatctaagacaaattcttaaaaatcaataagctaatcaaaataataaatatacatgtttaaaaatcaaatgacattaaaagcctcgtaatgggccaggtgtggtgcctcacacctgtcatcccagcactttgggaggccgaggtgggtggatcacttgagggcaggagttcaagccagcctggccaacacagtaaaaccccatctctactaaaaatacaaaaattagccgagtgtggtggctcattcctctagtcctagctactcaggaggctgagccaggagaattatttgaacatgggagctggaggttgcagtgagctgagatcacaccactgcactccagcccaggcaacagagcaagactccatctcaaaaaaaaaaaaaaaaaaaaaaaaggccttgtaatgagcaaccaactcttgtcttactctacgtccacatctgagggaatcacttttaatcttttcaggtcttttttcttgtggttaatgctatagctctaaataatcaactggtttactgctttatcaatgctagattttgttgactttctgctgtgaataaataaattctgatttaggtcttaaaatacacctccttccttctcccaatatagttgtattactatgtttagttcaattaataaggtgttggttatgactcagtaaatgttcactgcagatctaaacagtatactatgagtttcttttgtctttcatggagtttttaataacaagaaagtaatagtgactctccattcgtactttgtttttgcctactatagaactatcatataagattattttttaaagtactgtttttttctgggagaagtcctaccctctttctagacattcccttctcctgctctgatatgtgccagtggcttctgggtgtgttgttctcatccttaaacttccctggcctgatgtcctttgtcggatctgttgatttatagatcccaagtcttccttttctttgtaatacatcctcattctgttctgcatatctctaagtaactttattagaaggagaatgaaggagctgaattttgagtcttcctgtgtctacaacgtattctgtcttcacacatagttgcttgtgtagctaggttgagaattgtactttgaaaagtattttcctgtagaattggaagattatactcttctagcatctggagttgggaagttttgtgccattctgatgggtgttcctttgaatttaactcttttattttcttctctggtagcttttaggctttcttgtacctcatgatctgaatttttattctgtaccctcattacttgctgtttcattataatgtgggcacttgattggttctgtctgaggatcctagtcttttgagatctttaagaagttccgcaatcttaatattacatggtgtggcttccttcaggagtttgttagggatttggaaattcccaaatattctgctaacttatacccttgagagaggggagaataaacagaggagtgaatgtgaacttcagaattcctagcttcatagtctaaatagaaatcttctaagatcataaaatgtccctaagaactcatgctttacattattttttttggtattttttctattgattctaagcatggaaatgtagatggagattttgttgatgtattttcaaattatgtatcaataatagtgaagcttacttgatttctttaaaatctggtcactatatctataaatacagtggacattaaatgtacagcataaggtaattatgtggactttaaaaaggcattaaaatatgtgccattttctattattctgctcagtagcctcctaaaagcgtgtatgaacatgcccaacccagtattgggcctccgtaggcgctcaataaatgttagttgattgcccctttctgcttctaggtacataagcaccatattaatttatatagtatatttgattatgttaggttaatgcataaatcacatggattggttgtttcttttacagatcactaaagtggttcttagcaaaggttggaggtgtcttgagtgcactgtgtgtgaggcctgtgggaaggcaactgacccaggaagattcctgctgtgtgatgattgtgacataagttatcacacctactgcctagaccctccattgcagacagttcccaaaggagactggaagtgcaaatggttctctagggtttgtttgccttgttagtctttcaagttcagagctttctcataccactttagtttttaaaaattagccatacctatttaattgaataatacacatattctatgatagataccactaatcagaaaaattttcacatacacattaaatcatttgccccattatgttcgtatgtagcttcctgaattacagtaactgaataactaagaaaataaaattgagacttttcggggggatttggatttcaggtgtgtttggtgcagacactgtggagcaacatctgcaggtctaagatgtgaatggcagaacaattacacacagtgcgctccttgtgcaagtttatcttcctgtccagtctgctattgaaactatagagaagaagatcttattctgcaatgaagacaatgtgataggtattgtgctattttttcatctttttaaagcttttctctttgaaatgtagcaaaaaaaaaaaaaggaaaatagcttttccttaatcacaagttttaggtacagagctttttgccttgtagatttttagtcacctagaaacttacagaattgatttcctgttttgaactctcaactccagactaaagttttgttttgttttgttttgttttgttttgttttgttttgttttgtttttaaatttacagacagagtcttgctctgtcgccaggctggagtgcatcggcgctatctcggctcactgcaaactccacctccgcctcctgggttcaagcgattctcctgcctcagcctccagagtagcagggactacaggtgcatgccaccacgcccagctaatttttgtatttttagtagagacagggtttcaccatgttggccaggatggtctccatcttttgaccttgtgatccacccgcctcagcctccctaagttttatgattataggtgtgagccactgtgtccacccaagactgaagatttttaatttaggcctttttgagggtttaggaatcccttgaaattagatggagaattattgccttcatctatgctgtttcttatgaaggatttctgaatcttttaatagattataaaaaatatctaacactttctgttctccttaaaccactttctctagaagctctagatactagatatctaggtattagatagcaccttctgccctccctacgtaattatgtggaatttcaaaatcaagaatgtttccttgctttcattggtatattgttgtactctttagaagttaagcagtgaacatatattgatagtattattttatcagtagtacagtattcttgggactctggctactaattatctgttccattgcaagacaactttttactttatttcccaattaccattcaacatcgctttccatgatatatgtctacttcaagttagatgcattgcctggagcccatatatgctagcactgccatttgccgttttctgaatacctttgtgtttgccctaactagcttccttgctgtctttgaaatatttaatatatgatgataaaataattagcttccttatgtaatgtgctttgcttcctctctaatagttgttctcattcctttttatttcctccttagctctatgaaagtttttctgttaatagggatagttaggagaaaagggcaaggtaggaggagcatgtgaggcttagggcttttaagtttgatgactcagtgttacaggttttaaaaggtagcagttctcagtatattccattttttttaaaaaaatgtacaaatatggtctttttagatggatgcatgcagttcgtcagaacttaaatactgaggaagaagtggaaaatgtagcagacattggttttgattgtaacatgtgcagaccctatatgcctgcgtctaatggtaagagaataatttaaactgtgagtctgcactcttgtaccactcacttgcaccttactgtccataaccaatgaattagcttagctctactctattttgtctttgtgaaacttactttgacaagtattttatgaaaaatattattgttggttatacatgacttatcacaacttgttataaaacaatttacatgaaacaataaaaagcatatactttagatgtaaactataattttgcttccaaggaacatgatcttgtagttattgacaatatgttaaaatccaatgtgttgattctttcttagccaggttttcctccatgacttgagtatttccttcatcacttcttgttttgttgttgctttaaaaagtgcttttaactttagtgttcaaacatttattttaataaaatgagtatagaaacagaaattttaatcatatgtaagtatgtaaatacactctaccttttctgaaaagaattacatggatttttttttttcatttcagtgccttcctcagactgctgtggatcttcacttgtagcacaaattgtcacaaaagtaaaagagctagttaaaatttgaaatgctttacttaatttaattaatttactttgcttaatttttacataattggcttaccacttgtaaaatctgcttcaatcatatgggtgttctatccaaattctgtaatgttggtaatcatttccacaatgatatataaaatgtcatccagctttactggggcagtattcctataaatttcagcaagttggcaacaaaaataacagctcttagaataaccattaatgccatacttgctttggtttcattgatatattactgtgcttaattatcagttagcagaaaatacggcctagttagcaagcagatttcttttagaattaattcaatctcttaattttttaaaataattaataagcctagtatggtgattaatatgatattcttattaaacagtcattcttttgaatacttgtatttaatagcacctgatacaaaaacatttggatagtacagaaattgttctaaggaacaacagttttgtacatttaaaattaaatctgcaggatttgtacttatttattacttctccctattagtaattatgttgatactctgatttttccagatgagcttctggagtattctctcttctcttgtgtaaatagatccctgccttttgatcttttccaggaaaaagctcatagtggattagctgagcattgcatatatttgcagtgcttctaactctttttattgggacatgaacataaaaatgccaggaagacttttttgagacggagtctcaccctgttgcccaggctggagtgcagtggcacgatctcggctcactgcaacctccgcctcccgggttcaagcgattctcctgcctcagcctcacgtacagctgggattacaggtgcccgccaccacgccgggctaattttttgtatttttagaagagacagggtttcactgtgtttgccaggatggtctcgatctcctgacctcgtgatctgcctgccgcctcagcctcccagagtgctgggattacaggcatgagcccccacaacaggcccaggaagaccattttttaaaaacatgtaacatttctgcctataatccaaggaagtttgacctattgttcctagtttttattgggtatcatgaaattaattattcatgcatttcatagatacgtaattactttctagaactacagtcacattcccttgacatgggtattttggaacagtaatcagtcaaatttaaaatgaaagtttaaatttgtattcttgggattttgtaattttagacccacccaagacttatacccaggatggtgtgtgtttgactgaatcagggaagactcagttacagagcctcacagttacagttccaagaagaaaactgtcaaaaccaaaactgaaattgaagattataaatcagaatagcgtggccatccttcagacccctccagacatccaatcagaacattcaagggatggtgatatggatgatagtcgaggtaatactaatttattttccgtgaaatatgtgtgcaagaattacagcatataaagtaacttttgaaatatgtgtatggtttaccaaagggtaaatcacactgacttagataaccccgatgtgacccttgccatctccaaatgagtgatcttcttagaccttgccttttcgggttctcttcctttcacacattttagaacagacctaccttacagaaatctcaaggagcaccatatctttgaagatcacaggtggggaaatacagaggtcttgactttagtttgctagataacgacacaaaccttctcagatactgtgagcttggataataccatgtttaagttaaggtagttgaggcatacattctagaaatggaaaagctgtcatttaatattacttcaggtataacttcatattcaccagtgtgcatcataaagtattggtttataaacattttcttaatcaaagtaaatataaggtttttctagctgaattctttttttttttttttttttttttttggttgggagacagggtcttgctctgttgcccaggttagagtgcagtggcatgatcttggcttactacaacctctgcctactgggttcatgcgaccctcctacctcagcctcctgagtagctgggaccatggatgtgggcccccacgcctggctaatttttgtatttttttgtagagatggggttttgccattttgccaagactggtcttgaactcctgggctcaagccatctgctctgctcagcctgctgaattcttgagatagcaaaatattttaatagtaacctaaaatccaatatgaattaaagaggattactgtaggtttcctcatttttggggcagttatttattttcaactgattcagaagtgaagtgataattatttctgttccattacattttatttcatagctttttttttttttttttttttttttaaggggcagtgtcttgttacattgcccaggctggtttccaactcctgggctcaagtgatcctcctgcctcagcctctcaagtagcaggtactataggcatgcgccactgcagccggcttttagacaatagaatttattgaatacctactgtatgtcagatgttggaaatcatatcagtgtacaaagcaggtagaattctctgcatagagtttatattttaatgttaggtaactcaactcttaaaaaaaatcagttaattataatgtgtttggcaagttccatggtaaaaataaagtttgataaagaggaattgcctggccaggcacagtggcttatgcctgtaatctcagcactttgggaggccgaggtaggtagatcacttgaggtcaggagttcgagaccagactggccaacatggtgaaacccgttctctgctaaaaatacaaaaattagccgggctcagtggcatgcacctctaatcccagctacttaggaggccaaggcaggagaattgcttgaacctgggaggcggaggttacagtgagccgagattgcaccactgcactccagcgtggttaacagagcaagactccgtctccaaaaaaaaaaaaaaaaaaaaaaaaaggaattggaagtacagacaggtgtttagagtccatatgaacagaaagcagtatttgagcacagattttaaagaggtgagtgagtgagccacttgattacctgagagaagagcaccccagacagtgaagaagccagtgtaaaggctctgggtgagagtgtgctgagcatgtttgaagagtgttgtggagaccaacagagtgagcagaggggacagtcagaaggtgagaagattagagatgtgaggacaagaaggacggctcagtatatctcacacaaccataaggtgatgtgtcagtagtttgtgcttaatagcaatggaatgggaggccattgaatgttcctgaaaagaagaacaccatgatcttatttatattttaagaggaacactctcctatgatataagtagatgattaggtgcaagagttatgacaggtagatcagtgagaaacaatggtccaggtgagaggtaattgtggctttgaaaaggtatgtcttttgtggccgggctcggtggctcatgcctgtaatcccagcactttgggaggccaaggcgggtggatcacctgaggtcaggagatcaagaccatcctggccaacatggtgaaacctcgtctttactaaaaatacaaaaattagctgggcgtggtggcaggcacctgtaatcccagctatttgggaggcagaggcagaggattgcttgaacccaggaggcagaggttgcagtgagccaagatcgagccactgcactccagcctggtgacagagtgagactccatctcaaaaaataaataaatacatgaaaagatatgtcttttgtatgttcttgataatttttgttttgtagtgtgttttgggtctatgttgctgggagaaacactttctgatgtttgtatgtaactgattttcagatacagttgaacaggtaatttgatttgggggcttggagtttgcaaagaagtagtccatatacttggaggaattgatcagatcagcattaacaagaatttccatttctgaggatgttaaaaaatgtctgaaaaaggtttccatagtctcttaaatttgggaagtgctccatttcacaaaatatgaaaggtttcttgataatagtacacattgtttcccaaattatgtgattataataccttttaaaaacaacacagaagatcttggaaggttttccttgtgacttaccacttgtaaacactgagaaatggtgatatgtttcaatttcatattttctcattgactcgtatcatggtaaaagaaaatcagttgaaaaattacccttgcttttttaaaatttacgtgataaaatagcccatctgaatttactgaatttgtctttatttttattgaatatgaaaaaagattgtttagtgtgttagatgttaaatgctaagacaattttagaatttaaggaattgaatatacagtattttcatgactagtccctcacgttcctttacatgccaggatctcacatcctttgcagaaggaaaggtacattcctagggataaaataaatgcatgttacttggacaacatttttgctttctgtttgctaaataaaaatcctttttaaaaatttagtattgccaaactttgccatattaaaaatgttttagattactatattatcctgaaactgcatgtacacacacaccactaaaataagttttatggtatttcatatgcctgtacgggagaaaaaataggaaaagaatacaatcatcataagttcttattattacattatgctgagatttctaataacgctgcccttttctgggtattttgtattaaacctaaaatttgtgatgttttagactgtttcactaacatgttttgataacgtctcagtacccttgggaaagcattataaagtagtgggcaatgatgaaacctactctggatgtttttaggcaaattttttaacttctctgattctagtgttctcttttataaaataggtgaaccaggatgagcccataggatagttgtgctgatgaggtgcaaggatgcatgccaggcacccagcactggctcttcccagacatggagtgctcagtaatcgtgagctattagaatacaggtgcccaaccagtgcttgagcaattgtgttctgtgtccaacagaactcaacagaatcccacgtttgtctttatatgtgaattcagttccttttgagttagtaagaaattttgcctgtgttggggtaattgaactttcaggaggagggaattgtctgccacaattattctctgaacttaatgtttccatgtctttttcttcattttggaagttgtggaaaaattataatgaaagagtatataaacgttttcctctgtattatagcgtatctgacagtttcctttattaaaaagtatgatacattagggagagacttaatgaatttaaaattaaagtttgaaaagtgttattgactataagtgatcttcagctgtgcagttttcaacttgaggttgtcagaatgtaatattacacattatattacacacatctacagaatccaaattgtgatgttcctggagtattggaacaatacctatgactttttgtttctattgatttttaactcttctaataaccacttctttaagaaaagtcatacatcatcactttggtgtatcagaaacaaattccttatgcaataaaagcatacttctttctcattcacctactgggatctagaaaccctgttaatgcaagaaaaaatcccaaacctcaataaaataacactctgtttgtctgaagagtggaaacacaacacatttcctctcaactggtggtcccagatcgaccatcacagtgtatggatgtgtttggaggtgtgggaataggactgctctgaggctctagaaggccagcaggttgggcagactgaatggagggaggggactggcattcagtaactactggagcgtgggaagagtgaggtagactgtccatctggtgaaggtggctgcttccttgaggtttgttactttctgtaatgttaattccctcaacttttaaaatttgatttttagacaagttatacattcaaatgatttaaaattggaaaataataaaaaggtaaacagtgaagtctctccctttcccctgccttcatgcccccagtttgcatctccagaaacctcagaggtttctcgtgtaactttccagatgtgttttatgcatgtacaaggaaatgtgtgtttatatatatatagtgtgtgtgtgtgtgtgtgtgtgtatatatattttgttccttttgtcttactactttttactgtccttcatttttttatggctgcaaatattcctttgtatggaaatataagcaatttaatttacctgttctttcccctgttgatagacctttgggtttctttcaatcttttttttttttttttttttttttttttttgagacagagtctcactctgtcacccaggctggagtgcagtggcatgatcttcgctcactgcaagctccgcctcctgggttcacgccatcctcctgcctcagcctcccgagtagctgggactacaggcacccgccaccacgcccggctaatttttttgtatttttagtagagacggggtttcaccatgttagtcaggatggtctcgatctcctgacctcgtgatctgcccgcctcggcctcccaaagtgctgggattacaggcgtgagccaccactcccggcgttctttcaatcttttactgtgaatagtacaatgaatcacctggtatatttataatgttgtaggtaagtgggcctgcaaaggtgaattccatgctaaatccaaagacataatgcatttgaaactgtttttggcaggtaggatacagttttttgtttttttcttcatttatttttattatacatatctgaggtatacaacatgctttgtatacatagtgaaatgattactatggtcaaacaaatgtctgtatccttcaccttccatagttactctctgtgtatgtacacctaaaatctctttcagcaaattttcagtacacaatattattaactatggttctcatgctgtgtattaatttgatctctagaattattcatcttacctaactgcagatttgtaccctccgacctacttctgcccatcccacccatcccctacctccagactcttgataaccaccattctactctctatacattcagcttctcaccccccggcctcccattctgcttcttaagtgagatcatacagtatttttctgcgtctggcttactttatttagcatactttcctcccggttcatccatgttgtcacaaatggcagtatctcctttcttaaagctaactattccattgtataaagtcctcattgtcatcagtaagttcttagaaactgtggttaagaggggaaaaaaagtatgacaaaactgattttttttttcattttgcattatgccaaaattagattgaaggaaacagtgttacttgaggacctgctgtatgttcatttagcttaacgtctcagttcccaagaacctattgatgacattaagggaggacttaatatatgtataaacaaatgtcacaatttctttatccattcatctgtccttgaatgggtaagtaaattgtccattaggacacttagtttgtttccatgtcttggctattgggagtaatgccgccatgaacgtgggaatccagatgtctctctcagatgctgattttattacctttgaatatatgcccaacagaggcattgttggatcttatggtagttgtattttttttaaggaaactctatactgttttcaataatggctatactaatttacattcctatcaaccatgtacaaaggtttcattttctacacatcctcaccaacacttatgtctttgcctgtttgttaatagtcattctaagagacaggagatgatatctattgtggttttaattttcattttcctcatgattatgatattgagcatcttttcatataccatttgaccatttgtgtgactttggaaaaatggctattcaggtccttgcctattttaaaatccagttatttggggatttttttttgctactgagttgtgtgagttccttatatgttttggattttaaccccttatcagatgtgtggtttgccaatattttcccctaatccctgtgctacctttttaccccatgttttttttattgctatgcagaagcttatttgcttgatgtagtcccacttgcttatttttgcttttgctgcctgagcttttggtgtgatatccaaaaaatcattgtcaaggaggatattaaggagtttttctcctatatttccttctaggagttttatggtttcaggtgttaggtatttaatctatttgagttgctttttatgtatgatgtgtaagataggcatcaggtccagtttcattcttttgcatatagatatctagttttcttaccactacttattgaagacaccatcttttccctattgtatcttattggacttgtcaaaaatcagctcataatatatgtttgggtttatttttgggctctgtattcagttccattgatccatgtgtctgcttttatgccagtaccatacgttttgataactatcactttgtaatataagttgaaatcaggtagtgtgataccttctactttgtttttctttctcaagattcttttggctattcagggtcttttatgatttaatacaaattttagaattgtgttttctatttttgtaaaaaatgcctttggaaatttgatagggattgcattgaatctgtagatcactttggatagtatggacattttaacaatattcttccaatccacaaacttggggatatcgttatatttatttgtgtctgtaggttttttctgttttatgagacagagtcacgctctgttgcccaggcagaagtgcagtggtgtgatctcagctcactgcaacttccaccgcctcctgggttcaagcaattctgctgcctcagccccccaagtagctgggattacaggtgcctgccaccatgcccgactggccaatttttgtatttttagtagagacagggtttcaccatgttggccaggctggtcttgaactcctgacttcaggtgatctacctgccttggcatcccaaagtgctgggattacaggcgtgagccaccatgcccggctgtgtgtcttcagtttactttgtcagtattttatagtgtttagtatataaagctttcacttccttcattaaatttgtttctcggtgttttattctttttgatgttattttaagtggaaatgttttcttgattttttttcagatcattatttgtataaagaaatgcatctgatttttgtatattgattttgtatcctgctacttgactgaattcatttattctagtaactgtggaatttttaggggtttctacatacaggatcatgtcatctgcacacagggataattttacccccttttttatgctgatgccttttatttccttttcttatgtgattgctctggctaggactatggtgaatataagtgttaagagtaggcatccttgccttgtagcagatattgaagaaaagctttcagtctttccctgttgtaggtttgtttttgaataggcaatacctgtgcatgatacaagaaatacaaaggtcttaaaaagagtgaacaatgttaagttagcctaccttttggccatcccttccttggaaagaaccagtgttttcttataactttccagagattagtcatctagatacaagtatgtatatatgggagaatttctcatatttgggtgatatggtctttttctcttttcttttcttttcttccggtctgtctttctttctgtcctcgtctcgtctcttctcttctcttttcttcatttcttttgatggagtcttgctttgtcatccaggctggagtgtagtggcgcaatctcggctcactgcaagctctgcctcccaggttcacgccattctcttgcctcagcctctggagtagctgggactacaggcacccaccaccacgcccagctaattttttgtatttttgtgtttttagttcctctcctctccaggagaggaacaggggccacagggagctgatcatgaaacacactgagggtgtttcatcagggaagtgacaggagcatagtcacattcaggaaagatcactgcctctgggaagacagagggtcagggcagagcctggaggccaggagagtgccaccttcaaacagggtggaggaggcacaattctggacagggatgtccatggccagaggagtgatccagctcctagaagatgaggagagaccgaaggtgaggatggctcttcagtttcaggtttaggcacctggacagatggtcttgccttctccagcggcagaaagcactgaaggggaaagaggttgggggaagggactgtgtaggctgagcagcctaagtctgagaagctgggccacttgcaggtgttggtccagggtgcaagtgcatttggtgaagggggagactaggaagggaggagaaagtctagtctgttactagacctcaccatgctgcaggtgtctgggccagcaggtcgcagccggagctgtgcagctggctgctgtcacatccctttctctcccagctgccttcagctgagcttaacgccagcagaggccgaaacacttcacaaatgcaacttgtcagctgggaggtgcactcagagctcaggaacactgttttccctctttattgttttccatcatttttttttttcagtctgggttttgggccccgtcagttccttttctgttcaacactgagctatgtatccacccctctcaaggttgaaaaagagaaagactgtaaaagtgccctgcaaagaagaggcttccaactctctgggggtggggggggtggggggctctcttcctcctcttgtcttctgggttcattccaaattattccccaaaggaaaaatcactgaaggactgggggcggtggtggggaaaaggacagtctcccaagaggtcaggtgaagccccagcctcatggtgttgagggaggggctgggggaagcgggagcctgttcctaggagacactgtctactggacacctcatcctagaaggcttccctgagttctgacactgttctaggagtaggaatcattatcccacgctgtggagaaggaaaccaaggccgggtaaagtaatgtagggcccttaaagttgcagagccaggaataaagtccggattggggctcaggtctgtgggcaatccaaggccgtcccctttacacttcaaatgctctttccccctccggaagccctcgcgtcctcatccctaccccacctcttgttccccaagcgtggctagggctagggctccagggctacgccaagcacccttcggtcttcccgggaagaattttccccggcccggggctagggtctggcgctggggcgctcctgggacctgcgggatcaccactacactctggcgcgccgagcgcggtgagctaggacgccaaggcacaggtggggctggagtccagcgcggaggcgcggggggcgggacgcggggccggggagcggccagggaccgcggcagcgccgcagtgccagcccggcgctggcgactgcctgccccagcccctcagtggcggcttgctctcttctctcgctccgaaccagacacagccgctgtcgctgccatgtggcgcgccgcagactcccgagaacagccctggctgtcagcgggcaccagccgcttcctgtgcccatcgcgtagactggaggggcgcaccacggccaccgagccagaggcgcttcaggaagcaagagaagtccccgcgcgctccgggacccggcgcagctcatggtgagcgccctctggggctcgagggtcccttggctgagggggcgcatcctcggggtgcccgatggggctgcctgggggtcgcagggctgtagttgggatcgcgcacaaaccgactctgcggcccagcccgaaatgctgccgccaaggagcaacggcaccgcgtacccggggcagttagcgctgtaccagcagctggcgcaggggaatgccgtggggggctcggcgggggcaccgccactggggcccgtgcaggtggtcaccgcctgcctgctggccctactcatcatctggaccttgctgggcaacgtgctggtgtccgcagccatcgtgcggagccgccacctgcgcgccaagatgaccaacgtcttcatcgtgtctctacctgtgtcagacctcttcgtggcgctgctggtcatgtcctggaaggcagtcgccgaggtggccggttactggccctttgaagcgttctgcgacgtctgggtggccttcgacatcatgtgctccaccgcctccatcctgaacctgtgcgtcagcaggtcatcagcgtggcccgctactgggccatctccaggcccttccgctacgagcgcaagatgacccagcgcatggccttggtcatggtccgcccggcctggaccttgtccagcctcatctccttcattccggtccagctcaactggcacagggaccaggcggtctcttgaggtgggctggacctgccaaacaacctggccaactggacgccctgggaggaggccgtttgggagcccgacgtgagggcagagaactgtgactccagcctgaatcgaacctacgccatctcttcctcgctcatcagcttctacatccccatggccatcatgatcgtgacctacacgcgcatctaccgcatcgcccaggtgcagatccgcaggatttcctccctggagagggccgcagagcacgtgcagagctgccggagcagcgcaggctgcgcgcccgacaccagcctgcggttttccatcaagaaggagaccgaggttctcaagaccctgtcggtgatcatgggggtcttcgtgtgttgctggctgcccttcttcatccttaactgcatggtccctttctgcagtggacaccccaaaggccctccggccggcttcccctgcgtcagtgagaccacattcgacgtcttcatctggttctgctgggccaactcctcactcaacccagtcactatgccttcaacgccgacttccggaaggtgtttgcccagctgctggggtgcagccacgtctgctcccgcacgccggtggagacgatgaacatcagcaatgagctcatctcctacaaccaagacacggtcttccacaaggaaatcgcagctgcctacatccacatgatgcccaacgccgttccccccggggaccgggaggtggacaacgatgaggagaaggagagtcctttcgatcgcatgtcccagatctatcagacatccccagatggtgaccctgttgcagagtctgtctgagagctggactgcgagggggagatttctttagacaaaataacacctttcaccccaaatggattccattaaactgcattaagaaaccccctcatggatctgcataaccacacagacattgacaagcatgcacacacaagcaaatacatggctttccagtactgctccctttatcatgtgtttctgtgtaatagctggtgtgcttagaaacctcaccccattgattgatagttcaaagaattggcagaagcagttgcaataaactcagtcaaatgtacccagcctaccagagatggaacaatgatcctgtgagagaagagagtatggtgctggctccttaaaaaaaaaaaaaaaaaaaagatacttggtccttaaaaaatatgctctcccctccctttttaaacaaatggctttttcagtcacttgtttgtgtttgaattgatttttaaacagcaggttttgtgtgtgtgcagtgatgtggtgggagcacacctttcctgggtctggattcccgtggctttgtgcttgtgtcatttcttctctctgtgctggtgggggtctctttaccatagcttaagaagtctccctgatttattctggtatctaataaacacagattatttgtattatgtggtgactatctttgctttgctacactgggtttcaggattgcttctgaagaaacgatgagtgcatccttaaaatgcaaagaagacatttgctgggtctggaagtacatgcttattctctttacagtttggccttaaagatacaccagggcaaaggaccttgaggagcttctgttttctcaggtttctttttattacttatacacatgttgggtctgtgctgaaacctggcttcaatggcatggcattagatcttctcaagcccagattttttttttcatttggaatcttttttgaagtaacatgagacaactctccttattcctagacagatgcgatcagttcattgaaaagttcatgtagaataatatcttgaatctttctccatctgaaatctgtagcatgttttagaatcacatggcttttgagaaatcctgttttctgaagggctttgaaatgtgtgaatcaagatgctttaaaaaagaaatctatttttaaataggcattttccttagtggacaatagcaaataaagaaatgctttttaactaaaatgtagaagccagagatgaaatgtgaatgaacttgaaattggaaaatctgtaggtcgaggtgctcaatagaaaagcccagctgactccaatcattttgtttttcctctctgcagtgtgcacagtcaaggggagtgttttattccagacccacaccagttgagagcatagtattaccatcagatctaaatatgagcactattaatggaagcaaatgaaatgtgaatatgcaatttcttgcaagtccctgctttgaagcagttttatcaaggacagttcaatcaattttgatctctctaaggctaattttattgtcagtcttctgtgcagccaactgcaaaatgtgcagctcctggcacatcgtacttaataaatatttgttgaatgaatgactattctggaatagtgagattgaaagcaaatcctattcggtacatcaatttttatatataatttagtcaaaatgatactggaatctgaggcccgtgttcagtttctgacctcctgtgaatggatagctaagtgaaccattaggcaacattaggggcagtgaaaagcacacagctctacgattcaggagatggtcgcatgaccttgagtgagtcaattaacctttctgggcctcattttctgtctgtgtctgtaaatggaaagacttcagctggatcactgtttacccaattgtgctttgtgatgcagatgttaatggatggggtctctggtgaaataagttcagcaaacccaggttcaacacctgttttctcgataggacttcttagagcttctcctgtgcatgatgcatctccagtgcgagaagattctgtatcatttcccaatgccattcactttgtgaaccttgtttggtggaattcctgttactgtttcactggagtccacagtcactacttgagaaactcaaatctaactgatctggaagtctttacaatattctgttctaaagcatgggttgctataagcaaaatcttttgtgaaaaacactgttctaggctccagtttaaataagttctgtgttatggaaaatgggttatgtgaggactttggaatttccttctgtaaaatatcactcaccattcattataattacgtactatgctctaggcattgttctagatgctgggaatatagttgtcaatcaaattctctgctctcttggaacatttatgtgagctgtgggagagataagccaataaagagatctgtactatactgcactgcattgcactgtgctgtactgaccaggatagataatgccaggcaggggtaattgctatgttgcaaaaagcccagggtgagtagggtggtgaagctgctgttttatttatggtggtcaggggaggactttccaaagagccacatgaagagagaccttgatgaagtaaggattagagggctgctaatgtctgggaaggagagcaatccaggcagagggagtggcaagtgcaaaggcttggaaatgggattgttcttggcaccctcagaggagtgtggctggagggctataaaagaggagtgtgataggattaatgttaattgctgtagcagcaattgcagcaggcatgatggagacccagcctgtgctgggtacaatacatgtattaattcatttcactctcattgccctgtgaggtaagcacttttattaccccattttacagataaggaaatgaaggcattggcaggctaaataaccagcctgtggtcacataactcctgagtggcagagctcaacttgaacccaggtagcctggctgtggagtctttaatcctaactgctctttgatggtgagagaggatgccaggacatcttcagtcagcaaatgcactagtgcacagatcaggacattcagttttttgttcatttgttactgaaatggttaattgattcatccccacagctatacaacagcagatcttcactgtgtacctcctctgtgcacagctttgtgtttggagggaaggcaccctagggttatgggcaaagtagctcttacatgatggaccaattgctttcctggattcttatttattcctcacattaacctcacatgttattatttttccattttacaggtgaggacatgggggcacagaggaccttgaggacaaggttgtttgtccaaggtcatgtgaaaagtaagtagtggaaccacggttcaccctaggtcagtggttcttaaatgagggaactttgcaccctgcacccccacagatatttggcaatgtctggagacatttttggttgtcacaactgggtgtcaggtgctcctgccgtcttctgggtagaggccaaagatgttgctaaacaacttatggtgcacagagaattatccggccccaaatacccatcttgcagcacttgagaggccttggccaggcgggcagactccaggtcccagctccccgtccacaaggccacctgcctgggattggaggctccagtgccctaagtttgaagtttggctccaccatttattagtcttctgaatttgggcacctttctgagctccagcttctttatctgagcaatgggcacatgaaccacacagagcgtgaattacacaaaacacatgccccagatcttccttgttctgatacatgctgaatcttcttttataattaggcatccatacaccatattcattggttagaaatgagtcattacgtccaaatcatattcaaggggaggtgattagactttacctcttcatgggaggagtgccaaagaatttgcagaagagatgttttacattttatgctttatttttaaacacttgttctcacatagtttcagacttacagaaaccttgcaacacggtacaaagaatttctaaatattgtttacccagatcccccaaacatcagggtttcactgtatcacttatctctgttcttccctttttcttctgagtcatctaaggtgtgatgcccatttactcttgaatattttgttgcatatttcctaaaaacagggaattctctcgtctcatctacagactttattcagacttcacaataatgtcctttataacaaaacaatccaagaccatgtgttgcatttagctgtcccctgtaatttgaaagtttctgctgctttgtctttcttgacacagacctttgtgaagattacctggccagttacttggtataattgtccttcaacttcggttttttggtgcttttccatgatcagattctgttatgcatgttgggcaggaatatcactgatgccatgctgagctcctgtagctcaaggcatgaggggcaggtgctattaattagtcccattactagcaatgttaactttgttcatggggttacggtgctgtccaccgttttactctttataattaatatgtatttcctttggagaaatactttgagactatgaagatatcctattatttctcaaacttgcatccattggttttagcatttattagtagcccttccctgaatcagttattactgtggttgtcaaatcatgttttttaaaaaaattctgtaatctttctaaatgtattgttggttttctactgtaaggaagaacacttgtttatattattggcatcggcatagaatcttggttttctagttttctgtttgtttttgagacagggtctcactctgttgtctaggctggagagcagtggcatgatcacagatcactgcaaccttgactccagggctgaagtgatcctcccacctcagcctcccaagtagctgggaccacaggcatatgccaccatgcccaggtaattttttttttttttttttttttgtagagacggggcctccctatgttgtccaggctggtctcaagctcctgggctcaaacagacttcccacctcagcctcccaaagtgctgagatttacaggcttgagtcaccatgcccagcccgggtttctagtttttataataggttataatcttttacttgacgctgttaatggatactatttttacattccaggtatgggacctggggacacatgtgtcccatttctatgatattaacacaatgctcattctaggggcaacactcagaacactgttttctattgtcttctaagactgtccctgacctcaaatctctcagtgaactgagggtatccatacttatcatgatatttaggttgccctagatttggtgagtgggagccctttaagttggttcttgtgtccttttgacatgctgtcattattctttgagtagtttgttacttttcaacatgagatatgtcagactcatcttgtgtattccctgtccaagccttggaatcatccatttttccaaggagaccagggttccttctagcagaaaatgatatggagaaatcaagatgtgggcactagggtgtttattgttactggggtgatattgtttctatatcctcttaaaagacagagttgggaaatggatacatgtatatacatgcacacatattcatatgtgcatatacacatatccttgagcatctctatctatttctatgcctacctatgtacatatatcaaatcccatgcactcattttgatatctagcagacatattttaaaaaccatcacctctggttcaaatcttgattctctaatgttctagttcatgagaactggaagtcaaagagattaagttaccttcctaggtttaaaaaatgttaaaaagggaataattagttgcttaccttgtagtttattgtcagagttatgtgctatgatgcatgtggaatgtgtaagggtgttacacaatgagaatttaaaaatggtcttcttgtgactgtgcccttaagagctgagagtacagggcagaaccttcctgtttctatgtagtggttccatgctccattttacagacagtgtgagaagctactagggatcaagaattcaagagtcaatatgcaggagagggatagagtagctgaagagcaaactagacttgcctacacctagaataggaagaaatagcacaagatgtcaagcttgataggaggaagttgttgatatgaggggagagttaatcagagaatgttgagcccatgtggaaccccctggacctctaggccaatttgggggaagggcttaaagggaatatgagtacccctactcacaagagcaggcagagccatcagacttttgctttgacactgttaatgaagtaccattttgatattccaggtatgagaccaggggatacatgtctcccatttgtaggatattaataatacaatgccagttccagggaaaacactcagaactttgatctgattctcttctaagatcattgctgtcctaaaaactcttagtgaactatgagtaccagcactccaccaacactgacagaataaaggtgacaaccagcatttgttgactatctattgggcaaggtgctttgtatacatcttctcatggaatcactgcaatattcttgtgacataggcaccattgtcctcatttggaaaaggaggctgagagaggctcaatagcaagccaggttatacttctagtaagggatagaagtgggatttgaagagcatctactcctggagagccccccttttgggctttacacaactctttggagggactcaggaagaggagagctccttcatgtatattgcccatgggtcctctccaggtgaagtattttgaggttctgaaaccattatcagacttggctgtaaattccctctccatcttggaccttttcctgtgctcttccaatggccctttccaatgggtaattagacctcagttgtctacatgagtgagatctgctcagcatggagagggctctatttttctacacccttgataatttgtaggtttgggaaagcatgcccagtgtggcttgtcagggctaacacatatgccttcattcatatgtcaacttggcttcatgggtaggggctgcctggagtcctgggatgagaaagactacacaattgcattccaaccaatgacattgaggggactggctaataaatgatttctgttaggagcttgggaggtgggggatgtgtgaatgttctaagtacttgccattctgtgtctctccacagcccctaaacctgtctttcctagaaccacttgaaagttaaaatattgatgtctggggcccactccaaattagttaaatctgaatttctaaggaataggacctaagcttcacttttaaaaaaaaattgaatgtgttagaatgtatatagccacaattgaaaaacaccattggtctacactatcattaggcatgtttgaaaattatctgccttgaccctgccctgatcttgcctttgctacaatattaaatgggctcttattaacaatgaatatatctaattattctctagatcttttattagcttgaattattcttagatattctgccacataaaagtatttgaatgtgtagtctttgtggttgatggtctaatcagctaaactcaaacctcactgcagctgtgactagaaagtcctcattgatggagaatcctagaggtcctttcagagaagaaaaaataattcagtgggccaagctgtaatattttgcctctgattctcagattccttgttggcaaaatgggaatgcaaaataaatagagtctatagtcagtacctaataagtatttgttgaatgaataaattagtggaatacaaaattaaaatacttgtctcatcaaacatctagagaaaaaggagacagatatagagctaacccatgcctgttataccatttaatgctaggcgtatggaagcagatactgtgtctctctagtttcacaggctctcagagagagaggaactgtactctaggagctgcatgtgactagtcattctcaagaagtccccaccccaatacctgatttgatgagattctgaactttagttgatgctgaagggggaggagatttttagggatcttggcaggacacaagtgtattttgcatggggtggaggatgtgaatcactgggggctggaggacaggcttcccagcagcccctaagatggcctccagtgatccatgtctcctggtattcatgcccttgtataatcctctccactcccttatatcttggctgaacctaatgtcttgttcctaacaaacacaatatggtgaaactgatgaacagcacctctgagaagttacaaaaagaaaatgacttccatcctgctcaccctctcttgctctcttgctttcttgttctgatggaagccagcagccatgttgtgggtgttctatgaagaggcccagtagcaagaaaccagaggctgggggagtgtctgaccaagagtcagccaaaacctgaacctgctaataatcacatgagtgagcttggaaaggaagcatccctcagttgagccttcagatgagaccatagccttatattactccttgattgcggcctttgggagactgtgagccagaagacccagcgaagctttgcctgggctcctgactcatagacactatcagaaaaacacttgctgttttaagctgctaagttctgggttaatttgttatttagcaatagataactaatatagaagaaaagggagagaacatttattgaatcctttgctatgccccaggtactttgtaaatctttttccatttcatccttaagtcaacctggatgaaaatattcaggttcagagatgctgggtgagtgccaggggcaggatatgaatcactactgtttgatttgaaagcctgtgctcatttctctattccaggatgcaaaccaggagacgttttctattctatgtttcttttttcttttcttttcttttctttttttgtggcagggggacagggtcctgctctgtcatccaggctagagtgaagtggagcaatcatggttcactgcagcctgaaactcttgggctctggtgatcctcctgctacagcctaccaagtagctgggattataggcatgcgccaccacacctggatagttttttttttttttttaatttttattagagactaggtcgcactacgtcacccaggttggtctcaaactcctgagctcaagggcttcttctgcctcagcccctacaaagtgctaggattacaggtaggagccattgtgtccggccacattttctctgttcgtaaagtcagcagtagaatagctaacattgttgctaaacagtttgtataaaatgagtaattattagtgcccctgcatgcagccacctgctgttgctgaccttctgtgcctctgcagccaaacatacatcaggtacttatgtatacacactccacaggcacacagatgcctccacaatacacatgtgcccaagatgcaattgcaagcacacaagtgcacaaataagtacacacatgtgtcttcacaaagaactatctccaccttcattttctcccatccaagtactaatcaggtctgaccctttttagcttccaagatcagatgagattgggcatgttcagggtatatggctgtagcctacatcctcttttttttttttttttttttttttgagacggaatttcgctcttgttgcccaggctggaatgcaatggtgctatctcggctcacagcaacctctgcctcccgggttcaagccattctcctgcctcagcctccggagtagctgggattacaggcatgcgctaccacgcctggctaattttgtatttttagtagagatggggtttctccatgttggtcatttttaaatgaaagaccctttgagacagttcatacctaaatatgtaaatagtgcacaagattttgcagcctgaacagaaatggccactatagttttttctctttagcaattttctgtgtgctgtaaacaaatttgaaatctggctagagactttggaaatcatgttgaccactccccatattgtgcagatgcagaaattgaggccctgagggacttgcccaagtaccccagcaaagtggtgtgaactgaagtccaggtctcccaactcccagttgactgtccttgctgtggcactgtgcaccgtcggtggggagaacactcctggtccttaggaatccatttctaaaggacatcaggagcacaaacaagttcatgccctattgttctttccacgtaaaagaagttgatgacatttatgcttttctcacaatacaccattaagatagaacattgttgaattatttgtggattaaatacagatgtgcagggattttagggccctgattgattttctgttgaaagaagcgaaaggaatgttaatttacaactggcaaatgttagctcttaggaggaggcaaaacagcatttcgaaggcctgttttttgtttggttttggtatttcatgaaagagatttttctgtgcaaagtggcaggaagccattttcaacaagagctaaagggaatgaagatttaaaaaatggaccaaaaacaaactcaaaggtgccaggcctttgttactgcaagcccctcttgcaggatgagaggctgctaaaacaaaatcaataatttaagcaactttctgtccctctctcccctgctattctggtaaaatgatttgacatttcagacaacaaggaatgaacatcagaccaggaagaaaagggcttggttatgagtcccagttgtgtgattttaagtacatgattaaacgtttattaatttggttctctcatctctaataatgaaaccatcactcttacatcttgagtgtaaaaaatgctcatttactagaactcgccctgtatcagatgccacattaggatttgtgcggagtgatctcattaattcctttttttttttttttttgagatggaatttcactcttgtcacccaggctggagtgcagtggtgcaatcttggctcactgcaacctctctctgccacccggttttggtttcaagcgattctcctgcctcagcctcccaagtagctgggattacaggcgcccaccaccatgcccggctaattttttgtattattagtagagacggggtttcaccatgttggtcaggctggtctcgaactcctgacttcaggtgatccacccacctcggcctcaagtgctaggattgcaggtgggagccaccatgcccagcctcgttaattctttatagcagccttgtgaggaggtctgttcattctcactgtacagctgaaggtgctgaggctcagaaaactcaagcttgtcgctcagggtcacacagctaagaaatgacaaggtggagatttaaacctatgcttgtctggctaggcactgtcttatatagtaagagtgtggggatgacagattgcaaaacaaagcaaaataaaactcacaagctctgaagatgtagtgactgcctactctgcccctgtgctagcgacccagagttaaagatgggttctcatcatggtctctgcttctatggatccctcagtggcttgagaggaaagcaaacctggtggtggcaacgagggcatctaatattttggattccattttggactcatgtttaaagtgcatatgggctatacaggtgggtgtatgagccgaggacaagagcagaggtctgggtttgggaccaacatcaccaaagatgatagccaacactgagtgactgctgaatttgtgctgggcactgtgccaaagagttctcaggcattaacccattctttttttttttttttttttttttttttttgcggagacaaagtctcactctgtcacccaggctggagtgcagtggtgtgatcttggctcactgcaacctccgtctcccaggttcaagcaattctcctgcctcagcctcccaagtagctgggcctacaggcatgcaccaccacactcagctagtatttttgtattttagtatagacggggtttcaccgtgttggccagggtgtcttgatctcttgacctcatgatccgcctgcttcggcctcctaaagtgctgggattacaggcatgagccactgtgcctggctgcattaacccattctatcctcagactgatgctgtgaggctgctgtccttaccctgttgtacagagcagtgagaaaacttgcttgtaggtgaaagttaaaacttcaaggaggatttttcttgaaagccatcccaaggtttttctatttggtgattcatgatcaatcttatgccccaagtccccacattccctctattttgagtcactctgtctcataagagcccctggtgcctttgttttgcttcatttgaattctggattcagcatgcatcagaaatgttctccctgagagctggaaagcatttttgtgatggctgggctgcagggccattaagaaaatacctttgcacaccaacaaaaaagactaaagccttaattgctgatccaaaaggcaacaggaaaggatgcaccactgcatatatggtgagggatgcattgccttggtcagggcacaggtcctctgtccctgagtcctgtttccttgtgtgggtagagggcattttcacactctctgtccccaaaagacctcagggggaacaaaagagcagcatgagcagggggccatggtcatgggcattgactgggtgcttgctgcatgcaaaggctctgtgttaagcaccttgggaacactaactcatttactgtcccaacaaatccaggatgtaggtacaagtaatagtcccactttacaggtgacaaaaatgaggaatagagaggtttggtgatttgctcaagatcacacagtatgtgtggcacagctgagattctgacccacaggtgagactcttgagcttattcttctcactgaaccccctgcctctcatggttatgtggctcatgctcccatagccttaagtcctgaggctaaggaagggtcctcagataaaagacgtcaatttctgtgtcttttttgagcaggcttcatgaacatcaacactcatttgaggttactgagagcatttgcctggccttaacattgtcatcccaaagctgtttgccaattcattcccatcttcatagccctgtctttctccagcaggcttggtctgtggttctaatgaacacaggaggcttggttcattcggatgcaggaagtgaggaggaataacatgaaggggattgaccagatgcctcaattctaatcagctgaatggagatacttatgatacctccttatgcagtgctgtaacgattagatgggattctttatataaaggacttagaacaatacctggcatgttgttagtactcaattaactttatacaatatattagtcaggctttgttgtgatgatgccacataaaaagtaatccccaaatctcaatgctaacaacaacaaacatttacttctcatttccataggtcagctgtggttctacagggctcttctgggctggctagattcagatgggcctggatctgggtggtgaattgggttcctatttgcttcacttggctctcagaagaggatccaggggagtagcagcagctatctgaagcatgttcatctcatgctggaggacaggatcaccagaggccatgcaggaatatttaacgcctctgcttggatgtggcattcactgagtcacccacattccattagctgaagcaagtcacatggctaagcccaatgtcagtggggtggggaggtacaccacttccattgaaaggagggaaaacagatgtttgctgaacaataatacaatactatgatctatcacaatactatgatctaccattatactatgatctaccattaacatttcttgaatgcctaatagctctcaggaagtgttccaagaatcatggattctagagatgaatcacatagcagctctgctgtctgctctcaagggtgccctcactacagagtgtggtcactgcaatgacaaaggtggccccaggacaacttaacctctcctgaactattttaattctcacaatttccttgtaaccccagtatcactatccctattttatagacaaataaactgggactcagagaggttcagtaattttcttttgtccccatggctagaaaatggctaagcctagtaccaaatccttgtgtgattgttccagggttctgttctttgcatgacaactctggactcaggtatgtaggcagagacattagaattgagacagagactgaccaaaactctcatatcttggcaggagcccaagtctgcatatgtatgaacctcatccatatatatgcaagctgtggctgagacatctgtaacctagactttcatagctgggctactaacttcattcatctgaaggaagattcaagttataaactgccaccaattcagtgaattatccataaacttgtttctatattgccctatgatgctcagttcaagcccaagtcaaatgctccctcctgaaaacttctctgattccctagccaccagtttctgcctgtgttgcctgtccacagcaccaaacacttaagacactttctccatgatcctacaattttttttttatttttctgagacagggtctcactctgtcaccccggctagagtgcagtggtgcacatgatcctacaaccttgatgtatatattttaggcaatcactgctcacagaaagcccatattctcctattccacctccacagtccccagagttccagcccagtgcttggcattcagcaggggctagatgaaagtgtgtggaatgagtgaatgaacgacggatggatagaggctgctgggtccttaggaaagagagcagatgagatttattttttatttttgtccgtatctcctctttggtcctttggagggattttagtcaggatgggtctggtgcaaccaggtgatccaagggttataggcacagagggaagtaactggagctccctttgggtaccacagtaaacactggtggtggaatgccattgtcttatcttctgagaagtagcaggaggcttccatattcttgtgtttcgtcaactggctctaatcattaagctaaatactcagcttatgcaatgcacttagcccagctgatttagaagtggcaccttcccaatcagtctagagcatttgggtggtcactgtattccaacattcactacaattagggactgccagaaaagcctgattgtcttcactggttatttataaccaaatcatagtagcaatcattatgtaaaaagagctgtttctccacgcccccaacttctctgcctcgcccactcccaatgtcagtccttccattttatttaatgcttctggctgcagtgattagatgtaatgagagtgatagggctttgagttggaaagtgctagaggcaaaggagttttgttattctcatccttagagacacagaattcaagaggtaaaggggacttagagatttctagtccagcagtcccatgctatagatgggaaaacttgaggatcaaagttaggtagcttcatgaaaagggtataaatgtggaaatccaagactccagttctaactgaggcttaatcacagataacgtgtgtgatcttgagctacttgcttagtgtctctgggtctgagttttcctttctagaagatggggaaactaatacgtattctggagtgattagagataaggtgtagaagtagccaggtgtatggcagctggtacaatggatgccatagtaaaggagttggtgccagaatcactgcatcactgctctcttcccatcactccacattgccttcaactagctgagtgctcctgctgaagaaccgactcctatgttccctggctctcaacatgactcagtttgacttttcataagtgcaggtaagcaaggtaaaatgggagttctttttcctctctacagatggaaaataccagcaggagaccagccaagtagagctgggggaagtcttgagactcaccctatggtctccatgacctttgtcttagttcctttgagccgctaaaacaaaataccttagattgggtaatttataaacaatagaagtttatttatttatttattttttgcagtgtcagaggctgggaagtctaagatcaaggcatctgcagattcagtgtcttggtgagggcttgctctctgctttaagatggtaccttcttgctatgtcctcatgtggtggaaggggtcatttgttcatcttcatttcttttataaggtcattaatcccattcagaagggctctgtccaaatgccttaatcagctcctaaatgccccacctcttaaaactatcaccttgattaagtttccacatatgaaatttggagagacacagacattcagaccatggtagtccccatcctctgatgtggaccggcagcacactcacagtcttacataaatgactctgcaagtgcagctttctgagctccattccaattgtccctctccccacctccatagcagttttggtgaagccctatgtaatttcatgatctacaggtagatttgatagatggtgttatggtaccaggagtggggagcagccaaaacacaaaccctaaaatatgtggctctagggccagatggcagtcagcaagagaaccgttactgagggttggaaagatggtaatctatgttatgcagtggtgaaatatttggtaaagctgttgtaggaataacttgaagggcggatgatgtgctgaaggaacttgaagcttaaggtgaaaagatggggaaactgaacgttagtaacatcccttggtcactactgtaagaaagagatgagctcagaaaagaattggctaaattgtaagcaggtataaaaagaagtagagagggtccaggacttctggagtcccatttctcccaggaaggggcctgcctcagtatccatgccaagctcagttactggctgggagctgcttgtgggaatcacttccctctgagtgtgactcagtcatactctaaagtacgacatgactcttccttgcagagatctggacatatacagtgtccagtcacacggacagatgcagcttctgtggtcactctagatgatgctaacttccttatgctggcatgctatcctcataatgcaggctgcagttaactattttaaaagttaacatggtaagcagaagtgattcctctttggctcgaacatggactgtttggagggcactggagagaaccaaaagagtgagaagttttgagtgcttgtcatgtaagaaacaggaaagaaaatgcggcataattacctgtctctggggagaggagcaggattgcttttgttcctccaagtaggcagaaacagaaacactgggcagctggtacagagagacgggttttgagaggcagtactctcccagcagcactgtctagccagctgtctgcccgagtctgggggtgctagtgccttctgcaggattaccctataggaggcatttccagggtgctgatgtggactcatgccagaggtgacagtgtcagccatccatggtggaaacacaaaaataaggacacttagtgagcttggcccaagctattacattttcatctctgaggttatatttcccacacctttaccgttgaatgtccttttatcaaaatagtagtcattgtttaagtgatatctctatgttaaaccttacatttttttctttttaattttattgatttgtgaaatcctaaagtcttgaaactcctaagctagctgacttttcagatctgggatctcttttatctctaaatgattatgattcctgactttttttttgatataaacactcaactgccattaagagtgctcatgatagggaatagatgctgcatttgttcatgtttaaatactgaggctcaagtacctgtcagaaggagtttattatattttctaggctctctgaaattacatcagaaaaatgtgaattagaatataacccataaataatatctggccacatgcaaagtaattgaagatcaattgaaatagctattggattaagaaatagagactgaggtaaatttacagggtcagggaggatctaaggaggaagcattgacactggagcccagggacctgggattacagaacagattctaccagtgctaacttactgctccaaagaaaatatcaaatctgctcatccgcaggtactattcatcaagaaagggattacaagttcacaaatgtgttcaaaatgtacccatacttcgacatattaatgaagtaatcacattctacacatgactactccatatggaatactggggtgggggtgttccaaataaagagactgaggatttctcatgagaactcagtgtctgctagaaaatatctaagtaaaatattttacttatgtggaaggtgtggatgtttgtgcatcacaagtttcaagaatccctaaaatgtacaatggagatgaggagaaaatatcagaatttcccagcaccagaaatgaggcaagaaaaaattcagaggagttgtaaatgtgaaaagccaatggctggtcacacagcaacattgataaccttgtgccaggacaactagaataaatacataaacatacagattgaaagtatttccaatattagatctccctcatgtgagaactaaattataaagattgaagcatataagaaaataagctaccagaatttaggctaccagaataaattcgattacacataaatttctgatattgaaattctcacaaatgtttaagttggtagtggaagacaaaggacatataatcttgggagtcctagggccctgcccgctgccagttcctccatgctactacagctgatgctttctggaaagcaacacctcctggcaggaggccaaccagcacaaatatagagcattaaaccactaaagctaaggaccctcacagagtctattgcacccttcaccacctccactggaacaggcgctggtatccatggctgagagacccatagatggttcacatcacagggctctatgcagacaacccctagtaccagcccaaagccaggtagacctgctgggtggctagacccagaggagagacaacaatcaatgcactttggctcacaggaagccatgcccataggaaaagtgggagagtactacatcaagggaacactctgtgtgacaaaagagtctgaacaacagtcttcagccctagacctttcctctgacagagtctacctaaatgagaaggaaccaggaaaccaaccctggtaatctgacaaaacaagactcttccacaacccccaaataatcacaccagttcatcaccaatggatccaaacaaagaagaaatcactgatttatctgaaaaagaattcaggttagttattaagctaatcagggaggggccagagaaaggtgaagcccaatgcaagaaaatccaaaaaatgatacaataagtaaagggagaaacagtcaaggaaatagcttaaataaaaaataataataataataaaaaatcaggaaactttggacgcatttttagaaatgtgaaattatctggaaagtctcagcaatagaattgaacaagtagaagaaagaaattcagaattcgaagacaaggtctttgatttaacccaatccaataaagacaaagaaaaaagaacaagaaaatatgagcaaagcctccaaggagtctggcattctgttaaacgatgaaacctaagattaattggtgtacctgaggaagaagtgaattctaaaagccaggaaaatgtatttgggggaataatcaaggaaaacttctgtggccttgtgagagacctagacatccaaatacaaggagcactaataacacctgggaaattcatcacaaaaagatcttagcctaggcacattgtcattaggttatccaaagttaagacaaaggaaataatcttaagggctgtgagacagaagcactaggtaacctataaaggaaaacctatcaaactaacagcagattttgcagcagaaactttacaagctagatgggattggggcactttcttcagcctcctcaaacaaaacaattatcagccaagaattttgtatccagcaaaactaaacatcatatatgaaggaaagatacagtcatattcagacaaacaaatgccgacagaatttgccgttaccaaaccagcactgtaagaactgctaaaaggagctctaaatcatgaaacaaattctggaaacacatcaaaacagaacttcattaaagcataaatcacacaagagctataaaacaaaaatacaagttaaaaagcaaaaacaacaaaaaaaaacaaagtatagaggcaacaaagagcatgatgaaagcaatggtacctcactttttaatactaatgttggttgtaaatggcttaaatgctccacttacaagatacagaaccacagaatggataagaactcaccaactaactatctgctgccttcaggagactcacctaacacataatgacttacataaacttaaggaaagtggtagaaacaggcatttcatgcaaatggacaccaaaagcgagcagcagtagctattctcatatgagacaaaacaaactttaaagcaacagtagctaaaagagacaaacacagacagtatataatggtaaaggtctcatccaacagaaaaatatgacaatcctaaacatacatgaacctaacaccggagctcccaaatttataaaacaattactagtagacataagaaatgagatagacagcaacacaataatagtgggggacttcaatactccactgacagcactagacaggtcatcaagacagaaagtcaacaaagaaacactggatttaaactatactttggaactaatggacttaacagatatatacagaacatttcatcaacaatcacagaatacacattctattccacagcacatggaattttctccaagatagaccatatgataggccataaaacgagtctcaataaatttaagaaaattgaaattgtatcacgcactctctcagatcacagtggaataaaactgaaaatcaactccaaaaggaatcttcaaaaccatgcaaatacatggaaattaaataacctgctcctgaatgagcattgggtgaaaaatgaaatcaagatggaaatgtaaaaaatttcttcgaactggatgacacaacctatcaagacctctgggatacagcaaaggcagtgcgaagaggaaagtttgtagccctaaacacctacgtcaaaaagtctgaaagagcacaaacagacaatctaagttcacatctcagggaactagagaagcaggaacaagccaaacccaatcccagcaaacaaaggaaataaccaagatcagagcagaactaaatgaaatcgacacaacaacaacaacaacaccaacaaatacaaaacataaataaaacaaaaagttggttatttgaaaagataaataaaactgatagaccattagcaagattaaccaagaaaagaagagagaaaatccaaataacctcactaagaaatgaaacaggggatattacaactgacactactgaaatattaaagattattcaagggtactatgaacaccttttggcacataaactagaaaacctaggagagttggataaattcctggaaaaatacaaccctcctagcttaatcaggaagaagtagatacctcaagcagaccaataaagcaagcagcaagatcgaaatggtaattttaaaattaccaaccaaaaaaaccgaggaccagacagattcacagcagaattctaccagacattcaaagaatgtcttctttcattcaaagaagaaatgataccaatcctttcacactattccacaagacagagaaagaagaaagcctccctgattcattctatgaagccagcatcaccctaataccaaaaccatgaaaggacataaccaaaaaagaaaactacagaccaatatccttgatgatcacagatgccaaaatccttaacaaaatactatctaactgaatccaacaacatatcaaaaagataatccaccatgatcaagtgggtttcataccagtgatacaggaatggtttaacatatgcaagtcaataaatgtgatataccaaataaacagaattaaaaaaaaactcaaatgattatatcaacagatgcagaaaaagcattcgacaaaatctagcattgctttatgattaaagctctcagcaaaataggcatacaagggacataccttaatgtaataaaagccgtctatgacaaacccacagccaacataatactgaatggggaaaaggtgaaagcattctctctgagaactagaacaagatgaggagcctactctcaccagtcctcttcaacatagtactggaagtgcttgccagaacaatcagacaaaagaaggaaatagaggaaatccaaatcggtaaaaaggaagtcaaactatcactggttgctgacgatatgatctttcgccttgaaaaccctatggactcctctagaaagcttctagaactgataaaagaattcagccaagtttccagatacaagattaatgtacacaaatcagtagctcttctatacatcaacagctaccaagcagagaatcacatcaagaactcaaccccttttacaatagctgcaaaaacaaacaaacaaacaaacaaacaaaaaacttaggaatatacctagcaaaggaatcaaaagacctctacgatgaaaattacaaaacactgctgaaagaaatcatagttggagccaagcatgttggcacatgcgtataatcccagctactcgggaagctgaggcaggagaatcgcttgaacctgggaggcagaagttgtagtgagccgagatcacaccattgcactcccacctcagcgacaagagcaaaactccctctgaagaaaaaaaaaaaaaaaagaaagaaagaaaagaaatcatagatgacacaaacagatggaaacgcatccccatgctcgtggatgggtagaaccaatattgtgaaaattaccattctgttaaaggcaatctacaaattcaatgcaatccccatctgaataccaccatcattcttcacagaattacaaaaacaattctaaaattaatatggaaccaaaagagagccatgtagcccaaccaaggctaagcaaaaagaacaaacctggaggcatcacagtacttgatttcaaactgtacaataaggccatagctaccaaaacagcatggtactggtttaaaaatacgcacatagactaatgtaacagaagagagaacccataaattaacccaaatacttacagcagactgatcttcgacaaagtaagcaaaaaataaagtggggaaaggacacccttttcaacatatgatgttgggataattggcgagccatatgtaggggaataaaactggattctcatctctcaccttatacaaaaatctactcaagatggattaaaaacttaaacctaattcctgaactataaaaattctagaagataacactggataaacccttctagacattggcataggcaaggatttcatgaccaagaacccaaatgcaaatgcaataaaaacaaagataaatagctgggacttaattaaactaaatagcttttgcatggcaaagggaacagtcagtagagtaaatagacagccaacagagtgggacccctgaccctgacccctaaccttaaccctaatccctaaccctaacccctaaccacaactctccccctccccctaacccaaccctaacccctaatccctaacccccaacctctcttaacccctaactctaaatgttgactcctaacccctaactctgaccccaacccctatctccaacccctaaccctaaacttaacccctaacaccaaccttaagcctaggttcgttactacgtttgtattgactatgtcaatgttgattattatgatcgctgtcttaggactgcacggcagcgaggggattgtgcatcttatattaatgtttttgtgtcgaggcagtgcattagcactacaggtgcttgttacatgagcaaggggggtgtcatcttttgagtgccatgtctgcattaggaatgctgcatttgtcttccgaggctgcggtgtggatctcgcactgcggccgcctcaccttggctggggagaacctcggtgggcaggattcagaggggcttttggtttcccgttttccacactgaacccttctatctggtttctgaccctgattattcagggctgcaaacaggaaggattttattcaccgtcgatgcggccccgagttgtcccaaagcgaggcagtgcccccaaggtccgtgctgaggagaacgctgctctgccttcgcggtgtcccccgggtctgtgctgagcagaacgcagctccgccctcgcggtgcccccggcccgcccgggtctgtgccaaggagaacactgctccgccttcgctgtatctccgaagtctgtgcacaggagaactcagctccgccctcgcgatgctctccgagtctgtgctgagcacaacgcagctccgccctcgcaaaggcacagcgcgggcgcaggcgcccagaggcgcacaggagacctcaggcccagactccactccccagctgtgaaagggtaagaattgagggtggctgaggctcggggttgttcagggcggggtgggctctggacccagcaggcccggcacccaggtcagggatccaggggaggccaggtggggcgaaggccaagaaggggccggggctggtcaggaagggctcctggtgaccagaacactttgcgtgagccagcgtgggaggaaggtgggctggatgagccagggaggcgccgggaggggccttggcagaggcgaccccctccgtcagcccccaggccactgaaccctgggtagcaagaaccggcaggggaggctgcagacggaggagtggaggctccttggctttgggggctctgagcagaagcatctagggggtccctcaagagacccccaaatgctgccccatggtgagaaaacagggagaggccctgcagggaccccccggggttacaaagggctgccactgtgagaaggcaacgctgctggctggggctgggctttctacctcaccaagcctcttcccacccaaagggcccagagaggggcagctgcccccccagcgggcacagcacctcctccctgtgtgatggggtggggcccacagtctcctttctcgcggcctgcctgggctgaccctgggtcccagctcggccatggggcttcggcatgtaaagcccttggggggcagagcctcccgcccccgccagcttctggctctctgtgtcgcccccagcactggactggtgccttggagggaggctccgccctcctccacatcaacccgctgaggagttctgtcttcccagggttgtgagggaaaccagctctgcaggcctatgtccaagtctaggcaccgcctcctccagggagccttccagacctgatctgtgtggcagaggcccagaaggacctgggtgtggggatcctagagggaggcgggggacccagcgtgaggagagagggtcccagtgcttcctcctgagtgagggtcacccatctgactccggctgcacagagccactccctctaagcgctcctgctctctgccttcctgcattagctcttgcctgtacccggcccagcaaacccctgctcatctttcagacccaagttcaaggccccctcccactccgggtggctcatcacctggcctccccaggcagagaggctaggctcctgctcactggggcgtctcccttgcccactggcacgggactacaaggaaaggggttgacccccaccctcccccgccatgcccaggagggtgcagacacaactgggaaggtgctagagaccccggggggaggctgggccagcaccaggcattggggggcaggttcccgtctctacaccccagccccaggcggacagcgcgtgcccctcccgctgccccacctgtcacccacctgctggccccgggctgtctctgctcctggctcccctcccagctgcgtccccagctgcctctccagggaggagtgacagctggcctgtgccacaccctcgagcccccccggactaccccctccctggggcaggacccctgcctgtggcacaaccaaggggcctgctgatgggggctcatgtgagcagtgcctcagctgtgggtgtgggtgctgccagctgccaccgcctttgccctggtttcccagatagaccccgacccacactccgaagctgtatcatgaacgctgtggtgggcggctggtggggagcggggttgccgtcccactaccctctggaagcctcagccatgaagagcccctgtgggcaccttttcccggcacacggtgctgtgtttctccactcttgggctctgcagtgacttgaggggtcaagtctatgatcccacgggaggctgggctaatgaggggaccagagacctcagtgctgtgcagggagtcctgaaccaccctggtggaaggcccagcccaactccccagtcctcccgccagctccctgtggtgtccaggagacctgtggtcaggcctggaggagaagctcctcctcccctcgacatcctccctgcagcccttgctcttcaccagagcctcctgactccccaggaccccagagaggactgaccctctccagccgacctctgggctcaggacagctgggcggggcagccacaggagctgcctgtagggagcagagtcaggacggggaccgagccggacacccattctggaagtgtctgcacttccaggcaggggaaggacggcagtgggtagctgggagtgctgggccgaagatgggcattgtcaggccctcagtggggactgggaggtagaggtggggaggtctgtggaggaaggagaagaagggccagtgtcccgagttgggggtggttggcagtggacgaggccgacaggaacagacctgagcttggggagctccactcagaacgaggcatccttcagggttctgtgcatactggtgtccctggctgggggccgggccccgaagtggagcctgggactgtgagggtgggggggtgtgctggggtgggaggtggatggagccccccccccaccgcccggccgcttgggctgaaccttggacttcggagccggaacagacataggaaatggcctaactgcatttgcgcaggaacaccaaatccctcgcagctgcacggggctgagccagggccacgggcggggtcggccatcccagagtcctgacagctccgtggtgtatgccaaggggcctgggccgctgaccgaggggcgcctttcccaggccagaggcccccaccccaccccaggagagctgcccccctttcagttcccagaacggagcccggctgtggaatagtgatgcggtgaggtcatggggagggggcccgcatgactcatatcctggggtaggggaaagggaggagacggagaaggggcccagaggcctccacgtcctcagctctgctgggtcagaggccaggggctggcggggcttctccccagcactgggttttaggggagacaccaggagatgcttactctgcatccccactctgtcccccaggcccctagccagggagagctcagtcagagtgatcctccaggggcccagctctgcatggatgttcccagagtacacacctgggcctcgtgccagggccggcaccgccgttgtcagggctatggcaaggcaaacagtcaatgtttgcctcactaaagtgaggctgcagcaccctgaagggatccctggagggggacgtggtccccttgttcccaagcttgtctgcacatgcacgtggatgtcaagggttcccgtgtgtgagcacgtgcatatttgtatgtgcatggggtgcgggcatgtgtgcctgtgtggccggagcgtgggctcgtggagaatgtgtgtgagttgggtgtgcacctgcatgtgccccaggcctagggagtcccgcgcccggccgcactccttgtgttgggcatgagctgtgagcagagtgagggcctttatggggctgttggggcccggactcgttgcccttaggggtggacctaaggaaacgtgtgcacacgggcttctggggtctctgtgccaatgtgtgcttccaagccacgcctcccctatggcttggtggagggggtctgtggagctggagtgagggccctggacccattggaagcccaggtccaaggaggagcttgggctccatctcatgccccaggcccaaggacacacaccccagctgagaccttgctcacatagaggggctgggacatgggaacatggggagcaacatggccaggcttctcctccatggaaaccctccacctcctcaatactctgccccagctctgcgccgccctccatttggaggggctgggtcgtgagtgggggcgtgagtgagcatgagggcccctgcaccccaggctctgcctccccacgtggaacgaggcccagcagcccccagccaggtggctactactgcattcaatcagtgcccctccatctaacaaatactccctcatataatcagtactcctccatccaatcaatattccttcatcaacacctttctatacaaccaatagtcctccatctaatcaatgctcctccatccaaccaatactctgcaatttaaccactgtccctccatccattcaatgtccctccatccatcccatggtcccccagccctaccccatgagcagcatggaggcagacccacatctgtcttgtgcgccatcatctccctgatgctcttcaggaaagggaggtgtctcacaattgcattgaatggaggaaggcacatctttccagtgatccccactctagggctgcattgggaaatcgctcccagggaaaacacaaacacaaagcagagggttgcccagtgtgaccctctgatgtgaccacggtggctgtccactaaggtaatcctgatgcttttcctcctctgcagactgctggccagacccccaagctagcccgccaggcctccatagagctgcccagcatggctgcatccagtaccaagagttggtgggagacgggtgaggtacaggctcagtctgcggccaagactccgtcctgcaaggtaaggtcccctccaggggcaaggctgggctgcagagccagcactggggagtttagtagcaggccaggtttccttgttaagacaagcgtgggactgtccaggatgaatgtgggcagacagaaccctgaggtattgcagtagggttgggttcacccttgctggtgtagaaggctgtgttgtccgagtggaggtggatggcacctttattcctttccctgcttcttccactgggatcgcacagaaaaagttttggtaggcagatcccaggccccctggccaggtaaggcaaggcaggagagaagggcccagggcttctactccccaagatccaggggtctgcccttgtgacatacccttctgctgcccgcaggatattgtggctggagacatgagcaagaaaagcctctgggagcagaagggaggctccaagacctcatcaacaattaaggtagagcctaaatgtggttggtgcaggcaggaaatattaacttatttcattgtcacacgaaaccagaagacataaaacagttaaaataggccaggcacagtggctcacacctgtaatcccagcactttgggaggccgaggcgggtggatcacgaggtcaggaggagaccatcctggccaacgtggtgaaacttggtctatactaaaaatacaaaaaaaaaaaaaaaaaaaaattagccgagcgcaggggcacatgcctgtaattccagctacttgggaggctgaggcaggagaatcacttgaaccagcaagttggaggttgcagtgagccgagctcgcaccctgcactccagcctggcgacagagggagactcagtctcaaaaaacaaacacacaagcaaataaaaaaaacaaaacaacttgacacacttagaaaatgaaggtttgtgctattggttttcttttattttagaaaaacaaagcattgtttaaatatttcttacaagtacaaatataatttaaatttaataaatgttcaaaaatatctgtaattaagtttcattcagcagacatatgtctaatagagaacttgctaagtaagatataaaggatgattacatgaaaaaatcacaaaattgtcagtaagagtcttaaaagtcagtgataggacagtagttaaaagatatcaaatagttatttattcttaaacgttaaacaggatattaatagttttaataatcttgaagtttgacaacactgtgaaaacattacagaccacttttatttatgaaaatacgtgcaaatagcaaacaccagttgggcttaaggctgctacttacttacccagtaagtgacaaagctggaattcaaaccaggtttgagctataccactactacccttgaaaaggtttcattacactcagctttccttaatttcttaaactctttttttttttttttgattgagacagaatcttgctctattgcccaggcgggagtgcagtgacatgatcttggctcactgcaacctctgcctcccagattcaagcaattctcatgcctcagcctcccaagaagctgtgattacccgtgtgcgtcaccacacctggctaatttttgtgcttttagcagaggtggtgttttgccatgtcagcgaggctgatcttgaactcctgacctcaggtgatccgatccgcccgcctcggcctcccaaaatgctgatattactggtgtgagccaccactcctggccaatttcttaaacttttgattatactaaatatggtccttctgcgtgataacactgtttttccttttataaaattaatctcttaaaatactttaaaattcaaagtacactttttagattctttaaaatactctttgccatgttcatggcctttagatgtgtgatcatagcctatttgcttttcattgacttagtttcatatttctttgcctttttccccctacttttccttatagaactatttactagtaatgaaatcattttaaagaatacactttttattccacctgctaactgttaagagaatgttttataatcactctggtcatggcctgtaagtttcttttctaaactatcttttcaggatacatatttactaacttgctttcaaatgaatatggtcatgtctatgcagcaagtttcttttctttcttcttttcttcttctcttttttctttttcttttctttcttttttaaggcaagatttcgctctgtagcccaggttgaagtgcagttgtagaaacatgactcactgtagcctcaacctctctggctcaagtgatctgcccacttcagcctcccagccaagtagctgggactgcaggtgtgcaccaccctgctccactaagttatttagttttttgtagacatggattctcagtgtgttgcccaggctagtcttgaactcctgggctcaagccatcttcctgccttgacctcccaaagtgataagattacaggcttgagacattatgcccaacctctttttctttttctttctttctttcttttttttttttttttttttgagacagtcttgctcttgttgcccaggctggagtgcagtggcatgatcttggctcaccgcaacctccacttcccgggttcatgcgattctcctgcctcagcctcccgagtagctgggattacaggcatgcaccaccacacccagctgattttgtattttttagtagagacagggtttctccatgttggtcagcctggtcttgaactcccgacctcaggtgatctgcccgccttggcctcccaaagtgctgggattacaggtgtgagccaccattcctggccctctttttctttttaactaagcttatttatctcttccccagcttgagtctgggtcctactgtcttggtcagagtattttactatattgacctggacaattctgccatcatgaaccatattccaaacctaaatatgtaagaacatagaaagattattttagcaggagaattttaacacacacacacactttattctgaaaatttagcaacaaaatgaaaggtgagttgtggtagttgatgtatcaacaaatagaaagaagaaagcctgtaatctgtttcagaatgctatttctggggctggtaacatcaaaaataatcaaattaagtgttaacttgctgactcgtaagattttctctaatttagaagttggagaacatatatactcctattaccactttccatctttctcaaatatagtttttatagttttctgttggcttcatcatcgtattgaaagattattaatcacttacatatatgtagttttctgttaagtcctgttcaatatattacaaaattttgatctgtgtatgtaatatcaattaataagatggtgttagttaaatcagattacgtgttcattcattaagtcattgttaatacttcacagaatataaatcgtgttccatgagcatgaatttctctctgaattccacataattgtcttaaaattatgcaccatttattgttaagagtgaaagattatgtgtcatttattgtagtggtagaagaaaataaaaccaaaacagaatccaatccaaaagcttaggtttttgttgctactacagtaattacatcttcatatacgaaggacagcacattattactgtccaagaatggtgcctcggacaactggttgcttacactgttttcagagatgaaataggaacataagcaggaagatttttgtctaaatatgaagcaagaaaggcttaaatgtctttattcaggggattaggcatcataagtttttttttttttagagaaattgttttcatgatatttcctatctccttttgtcactttgcttttgtcggtaaattttacaactaaataaggattaccaggcataaaaagcagcagacaatcatgatgcaaactgaaaataatcaatcaaaactgacccagaacttaaatagatgttaaaattagcagaggaggacattaaaactgtttttatacatgtatctcatataatcaaaacattaaatagagacatgggagataaacaagaaaagccaaaatcaaactttcaaagacaaaaacatttgagatgaaaattacattggatgaactaaggcagattagaaactgcagaagaaaagattagcaaacttgaagatacaagaacagacactagctaaagtacaaaaagaaaaaaaaatgttaaaaagtgatttttaaaaagcatcagtgagcagtcaggcaacttcaaatggcctaataatatgcaggtaactggagtccccaaaggagaaaaaaaagaaagagaaaaaaaatacttgaagaaacaactgctgaaaatgttctagccataacaagacctattaactcacggatccaagaaactcagcaaaccccaagcacaagaaacatgaagaaaattacactaagggataacataatcaaattgttcaaaatcaaggaaacattattaatagcaggtgtataaaaagacatgttacctatagaagaacaaagataagaacaacatcagatttcttttgagaaacaatgcaagtgagaagacagcggtacatctctaaagttctagaagaaaaaaggccaactagaattctatgcctagcaaaaatatctttcaaaaatgaaggtgaaataaagacacaccagaaacataaataatgaaataattcatcaccaggagaccttcactgcaagaaatgttaaaggatattcttcagaaacaaaatgatgtcagatgaaaatctggaccaatacgaaggaataaagagcaccaaagtggtaactatatgagcaaacatcttttaaattttttattatttaaatctctaagagatacatgtttaataaaaaaacagcaaaatgttacagagtttataacatatgtaaaagtcaaatgcatggcagcaatagcacaaagtgcaggagggaggaaaagaaagtaaatgaaggaatgcttttattatagatgaagtgtacaatattacttgacctctctaaatgtgcactataatcttaaaggaaccacaaaaataatttttaaaaataggtaaaagtaataaaaagaggcaaactggaatcataataaataatgtaagctgggcacggtggctcacgcctgtaatcccagcactttgggaggccagggtaagcggatcacaaagtcaggagatcgagaccatcttggccaacatggtgaaaccccgtctctactaaaaatacaaaaattagctgggtgtggtggtgcacacctgtaatcccagctactcaggagactgaggcaggagaatcgcttgaacccaggaggcggagactctagtgaaccaagatagcgccactgcactccagcctggcaacagagcgagactctctctctcaaaaaaaaaaaataaataaataaagtaaaagcatgcaagaagaccaggtgcaatggctcacacctgtaatcccagcactctgggtggccaaggcaggagactcacttgagctcaggagtatgagaccagcctggacaacatagtgagaccccatatataaaaaaataaagtagccgggtatgatggtgcacaactgtggtctccactattgggaggctgaggtagatcacttgagcctagcaggtcaaggctgcagtaaggtatgatcacaccactgcactctagcttgggtgacagagcaagaccccatcttggcaggtgggggatgcaagaaaaatgcaaggaacagatagagataaatagaaaacataagaagacaatcatattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataacatataccatgcttacgctagtcaagagaaagctagaatagaaatactaatatcaggcaaagcatatttcagagttaaacacaacatttttccactatttgcagtcaaaagtatcgttaacactctctttactctgctcaaagttacagagttcttttgtataaacattagaacacttatcacagcctgcctataatggagaataattccatgttgtatactatacaacactcttactaaagtccattagacagaaatatgtagcatttgagacatcttccaattataaaactctatgcaaacaaaaattaacaaagcagttctgagactattatattatcctgtgaaggagggtctgtctgtctgcacagttggtcctaggctggcttctgaggacttgaatttcaagagggttccataactggtaatcatggtttactgtatctagactatggaaataatgtggcttatcctgctattctttttgtgagtctggaaatttcacacatgctaggcagagtacacatatgtgacccagccgagataaaacctgtgtttcttgggaagtcacataggttgttgtattttcattaagggggaaagaaggtagtctgtgtgatcctcatggaaggcacagcacataaggaagccggtacatggatttttccagactctgtcagtgtcttttgccattgagatctttctactatatatccatactatgttacagtaataaatcttagccattacaaccctaagctgatcccatgagtccttctagcaaatctccaaacatggaggcagtcttgtggatccctgacacaaatatagtgttgtgatctcttaaggtttatccttcctcttaaactataaagagctggctgggcacagtggctcacgcttgtaatgccagcactttgggaggccgaggcgggtggatcacgaggtcaaaagattgagaccatcctagccaacatggcgaaaccccgtctctactaaaactacaaaaattagcagggcgtggtggcacacatctgtagtcccagctactcgggaggctgaggcaggagagtcgcttgaaccagggaggcagaggttgcagtaagccgagatcgcaccactgcactccagcctggtgacagagggaaacttcatctcaaaaaaaagaaagaaactataaagggctgggtgcagtggctcacgcctataatactagcaccttggcaggcccaggtgggagaattgcttgggcccaggaattgagaccaacctggacaacagagcaagaccctgtctcttaaaaaaaaaaaaaaagaaaagttggccgggtgtgatggatcacacctgtagtcccaacactttgggaggccgaggtgggcaaatcacaaggtcaagagttcgagaccagccaggccaacatggtgaaaccccatctctatcaaaaaaaatacaaaaaattcactgggcatggtggtgggcacctgtaatcccagctacttggaaggttgaggcaggagaatcacttgaacctgggaggcagaggttgcagtgagctgagatcacgccactgcattccagcccggtgatagtgtgagactccatctcaaaaaaataaaaaagaaaagaaaagaaaagttagccaggtatggtggcatgcatttgtgatcccagctactctagaggctgagacaggaggactgcttgagcctaagaagtcaaggttgcagtaagccatgatcatgctactgcattccagcttaaacaactgagatgctatctcttaaaaacagaagtagaagcaaacaactataggggaaaatgagggatacatactttaagaatttttaaaaatttacatggaaaaacaccaggattctatagaaaataaaacagtattaaataactatttataaaatagatactagcaaattaccttacgtaaagattcaagtcagtaacttaaaggatcttacataaaagtactttccgttggttggaagagagatttttactatacactgtttttcaatttttttagacaaattacatttaaaagtttaaatttgcttatctacattcttaatgtgaattgccaccttactataggaaggctatttttgttcctgcagtctacaaaaagaacaaaaatattaaaaacgtacaactcttctcacagaactaagttggttttatacaaagacatctggcacaaaatacaatgatatttcaatatagaattacagcaggggatgagggtggagaaggaagagattgccagttctaagaggggagacaacagaagtatttttttaatgtcttattttaagagtaaaacacctgcttttttttgagatggagttttaggcgggagtgcagtggaacgatctcggctcactgcaatctctgcctccaggattcaagtgattctcctgcctcagcctcttgagtagctgggattacgggcacacgtcaccacgccaagctaatttttgtatttttagtagagagggggtttcaccacattggccaggctggtttcaaactcctgacctcagcctcagcctcccaaagtgctaggattacaggcatgagccaccatgcccagccaacactgaacattttgttcagaactagttaagaaaacagaaatatacattgggggtttatggattacttatttttggggtgcaatactgggaatagaagagaaaggagcttcctttccctctccttctttcattcattcattcattttgagaagaagtcctgctctgttgcccaggatggagtgcagtggcgaaaactcagctcactgcaacctccacctcctgggttcaagcaattctcctgcctcagcctcccaagtagctgagattacaggcacgcaccaccacacacagttaatttttatacttttttagtagagacagggttttgccattttggctaggctggtctccaactcctgacctcaggtgatccacctgcctcagcctcccaaagtgctgggattacaggcatgagccaccgcacctggccaagaaaggagctttagataaataaaatgattaaacatttgtagcatgtagaatgaaactattcccttagtaatactcaaattatccagatttccaagatgttggtagcaccccgagagcttcaaaagggaaattaaaagaaaaacgacgttacccttcctgaaacacagattcactgtttgccatattcttttctctagtaaaagatgaatagtttcccctggaaaaactaaaaacaatctgaggtatatttcagagaaaacaaaattgcttgataaaaatgccatgttaacaactgaggaaattgttttacatatattaattttaacacaggaataatatgtcaaaccaggatttctcaacctcagcactatcgacattttaagctgtatagtttttggtgtgggaggctgtcctgtatattgtagaatgtttagtggcagccctggcctctacccaaggggccagtaggacctacctcctcattcaagctaatgcactaaatttttcccttcattgacaaatcccattaatgcgtgtatttatcccattagttactctcttgtgttccaggtactttgttaggcaccagagaaaatatgataaagcaaaacagctattttcctcactctcatggtgcttacagccatggtgggaaaaatccataggaaaagactcacatacacaaatgcaggcagaataaaaaaactcacacaaacaaacgttgcagatgttgttaagttacataaaggagatatgcatggctgtgcatggtggctcgtgcctgtaatcttagcacttggggaggccaaggcaggtggatcacttgaggccaggagctcaagaccagcctggccaacatggcgaaaccctgtctctactaaaaatacaaaaattagccaggcatggtggtccatgcctatgatctcagctacttgggagactgaggtgggaggatcacttgggcccaggaggcagagggtacagtgaactgagattgcaccactgcaatctcagcctaggagacagagagagacgtctcctgttctcctggagaacaacaagtcatgatgtcagacaagaacttggattttggagacacgggtttgaatttcagtcattcattcttttattcagtaaatatttagcaagtactgacatgtcccagatgttgttttactcactggttatacaatgggagggagacagagaaagagggagagagagagagagagagagagagagagagagagacgctattctaaaagcttgaagtctaggctgtgcagagtggctcatgcctataatcgcagcactctgggaggctgaggcgggtggatcatgaggtcaggagattgagatcatcccggctaacacagtgaaactccctctctacaaaaatacaaaaaattagctgagcatggtggcaggcgcctatagtcccagctactttggaggctgaggcaggagaatggcgtgaacccaggaagcggagcttgcagtgagccaagatcacaccaccgcactccaggctgggcgacagagccagactccatctcaaaaaaaaaaaaaaaatgcgtaaagtctagatagactttaacccaggaataatccaaggaaatgaacaattacgaatgtgacaagggctgtgaagggaaagttcacagccttatcgaagtgtacagtagttggggaggttggccaaggcaagatgtttaggaaaggctttcctggggaaatttctctttgggttgaatcacagttaagtaggcaaaggggaagacagagggaagggaagtatggcaggcaggaagaataggcacttaatagctttgggatattgggcaggtcgcttgatctttctgagcttcagttttctcatctgggaaatgagttaataatagtcgtttagaaagtgtgatgagaccagccaggtgtgatggctcaggcctgtaatcccagcactttgggaggccgaggcaggtagatcatgaagtcaggagattgagaccatcctcgccaacatggtgaaactctgtctctactaaaaatacaaaaattacccaggcatggtggcgtgtgggaggcagaggttgcagtgagccaagatggcaccactgcactccagcctgggtgacagagcgagactccacctcagaaaaaaaaaaaaaggaagaaactgtgatgagatcaaaacagttaatgcatgagtgttctgaacctcgtttctccctctgctgtatctatgcagtttcttgacctgggctgtgctccaaagaggattctagcttggcttttgtgatagaggatggatacattattagacctgaaaagccagagcagggaggaatggtcccaaaaggaagaaactgtgcttgtcttcacaataaagagcagagaagtgggagaggtattgaaagctgtgggtggagttttgcaggtaagattgtgtgaaagaggtgagggaactacaatctaggggaatgtggataggagagtaaaagggaattctagagaacaatccctactgacttcacacaacttaagaaatgcaagtaaagggccgggcgcggtggcccacacctgtaatcccagtactttgggaggcagaggcaggtggatcacttgaagtcaggagttcaagaagagcctggccaacatggtgaaaccgcatctgggttagccaggcatggtggcatgtgtctgtaatcccagctacagaaagatagagaggtggctgaggcaggagaattactcaaacccaggagttggaggttgcagtgagccgagatcacaccactgcactccagtctgctggacaacagagcaagactcagggggtggggtgggggaaggaaagaaggaaggaaggaaggaagaaaggaaggaaggaaaatagaaatagaaatgcaagtaaagaatttcagtttgaaaattgccttttgtctactgaacatgagactgcttggaaactgggcaacgtggatttttataagttgtacaaagcacttagcaattttcaaacctctccatcctgcagagccagctcaatcacttctccagaaagacttactgagtcctctgcactgaacaggtgtcctgtgctccaggagagccctgggctggctcctagtgtagccattatgaccctggaatgcaccatctttcacatcactgcctggccttctagaatctcagcttcttaaatcaggaaattgtgtcttgttcatgtctgaattccccaagtgaacacagtgagtgggtgcttgacaaatctttgttggtaatgagcaaaaaaggggattctgtgcccaataccatgaaatcaatgcacagaagattcaatcaatcaagaaaggtgcacagacgctggccacacacactgacatttgttttcagatgttccagtccccctgacttccaccaacccattcattcattccacaagcatttttgctggggtggaagcagggccatacagggtgtgtaagtaacagatagggtgggtttgtataatgagtataaaaaacttctagcagaagatgacaaagtatatcaagaaagggctctcttcgaaatcacaccactgcactccagcctgggtaacagagggagattccatctaaaaaaaaaaaaaaaaaaaaaaaaaaaaaaaaaacagggatgggggcaagggagctctttttttccagttagcacaagattgccatttcagctagggattctactgcaactatctcccagaccctattctagggcccggggatagaaacagaatcaaaaacatattccttgtcttttttgggcttatattattgaggagagagaaataaacaatttcaaaataaacaatgtcatacagtgctaagtgctataaataaaatcaaacagaataacgaaagagaaagtagctagactggagggaaaagctgcttcagaatgagttgtcaaggaagcctctttgcaatcagaaaggtgagaaggatttagtcaggcaaatatcaggagtaaattattcttggaggaaagtaagcccatgcaaaggccctggggcagagtgggcttatttgataaagaggtaaaagggtcaggatatctgtagcaatagtggccaagggagggagaggtatgagacagaggaggtgagccctgttgccatggtgagggcatgaggatttattctaagttccagatacctggagttaaagtcccctgaactggacaacaactacaagccttcatatctcaatgctaccatctttaagcccctgttataagagctcagaggcttcagagatgacaggaaacaccagaacgctatggtggagcatatctaggtgccttctcccaactcagatcctttgactatagaaagacacagatttcaaggctgagatccacaaaactctagcaaatactgcacagacactgaccaatgacagcaggtgctgcctgtcaccctggagcaccaggcagggttccaaagcacccttgctgtgccagcctctgattgctggttatagggaggtctggggtagtcccaaaagctgggatgtctaaggcagctggggtcagtcaggaggctcagggcagtggcaggaaaatattttcctccctggtagagccacagcggggtatccaggctgaatattattggcgagaaggaccatggcacagcaccaagacctgcaggacaaactttgttggagctgaatccagaaaaacaatcttcttctaaaccactctcctgcccctcatttaattattgtgcttttgggtgcacttggactactctgaaacattcagaactctgtcaaaaaaaaaaaaaaaaagacctctctcctcagcacctctcccacttgggcatcagtcttggcttcctctctacttgctttcacttgctccttgtggcagagattgccctcagcagatcccttcccttaggttccttgctgtcaagtggaggctagggagcgagattatggccaatagaatgtgggcggaaccacagatctgagcctgaggaacatcccacaggaccctgagctcttcctccagctgctgcagtggccttggaagccatgtctgttctagaagtgtagctacagatggagaaggcccatgtgctagctagtctccaaagatggcgtatcaggccattcttgcgttgctataaagaaatatctgagataagttaatttataaagaaaagagtttgtattggctcattgttctgcgggcttcacaagaagcatggtgctggcatctgcttggcttctaaggaggcctaggaagtttacaatcatgagcaggcacatcatgtggccaaagcaggaacaaggaagagagagtcggtgggtgtggggagggacatgccacacacttttaaataaccagatctcacaagaactcactatctcaaagacagcagcaagccatgagggatctacccccatggtcaaaacaactcccaccatgccccaactccagcactggagactgcaatttaacttgaaatctgggtggagataaatatccaaattgtatcagagggccttccctcgaaccaaacctcctggtttccaggtcccctttcttgctgcttctgggctggcctcctgggaagccaagactgcagtggctctgatgctgcatgggggctgaggctcagccatgaggaggctcgcagctgccactttggtcttttggaaactttgctcgtgagagtctccccgttgggccgcagccaccatgctgagaaataagggtcatgtggagaggccacatggaggttttctggtctagagcacaactgagctcccagaaagcagccagcatcaatggctgggcatgtaagccagctggcatggacattccagaccagtctgtccttttgtcaccttagctacagggaaggcccatgaccccagaagtgcccatcattatgctgaattcccgagcctcagtggtccaccgaggtgtggaagcatgtctcacaagggtcagatggagttctggcctggattgatgtgtagaagctggagagagaagctgggtttctttcagctggggtggctctgctgggatgtggtgggccttttgggtttccaggtggtcattttccttatttgcagtagaaggaacgaggcccatatagagaatagagcaaattaaaaggagagaaagagaaaaaagtaaggagagagggagaaagagaaaaagaaggaaaagaagaacggagggaaggaggagaggaaagaaaaagagaaggaaaatgagaaggaggagaggaagaggagagagagagagagagagaaaataacttacttgaacctccaaattcaggcataccatggtctttgcagttataaaaatcaataagtcacccttcagctgaaacatgtctaagtggagtttcagttgttacaactgacagagccctgcctagcacaaggaataaacaatgttcagcagtggcatgagaacaagggacagcctgtttggtgggcagcatggcaaatgactgtctggaaaatatgatgcttgggctggagggcaaagtggaattcaccagcatgcagggtggaagtacgaccctagcagacggaacagcactggcaaaggctcagaggcaagaagctttacatgtgaaaggatacatttttagaacactaaacattctccctgttatccaaaacactgagtttctcttcattttttggccaggtgtggtggctcacgcctttaatcccagcactttcggggctgaggtgggtagatcacctgaggtcaggagctcaaaccagcctgaccaacatggcaaaaccccatctctactaaaaatacaaaaattagctgggtgaggtggcagacacctgtaatcccagctactcgggaggctgagggagaagaataacttgaaccaggagtcagaggttacagtgagctgagatcgtgccactgcactccagcctgggagatgagacagagcaagactatctaaaaaaaaaaaaagactgagtttctcatcattttttgaaattgagagttttctctgtatcgataagaccttataatgcaaaatataatataatatgcagctaggtctccacagccttcagtctttcccagggagggttccatgagctgcttgtctggtggggatggtggttttgagcaagtagttggtgtcctgtcttacccaggctctttcccacaaagagttgggaagaattaaaaactactggaaaccaagatctctccctgatgttgactttcagagctcagcctcatcagcacaggctctaatcagctaagcagctgcctcgtttcatccagccagagccctgatctcaggggatgatagtgaggaaatgatcctttcacatgcctggctcctgcaaaattgtgctaagaggattttcctcaaacagtttagcacagagcgaggtttcctgatccagttagcaaatattcttctgtttgaactcactgaccctcctttttctgaagatgtattttaaattggatttgcttcactgacacaaatggaaaacttgataagaaaatcggtgggattttgctgcacccactgctgatatcaagactgaactctgtattatagcaagaaaagctctgttctgtggctacaggatacatgctgagctcccagccaccagccctgccaatgtgctcagcttggcacagggcagggagcagggtagaggggaggggatggggaggggcaggtggaaaggctcaggtgatgagccagccacatcacctcaagcacaggacccctgatggtggccctagatcctcctcttgaaatccaaagctcagtccctctccccagttcaggagcaaggaggtttctggcaggttaaaatggctaactcaagagcttgccacctttgaaaggcagcactgtgtagacagaggcagaaggatgggcttacgagacagtcctggcttcaaatccttctctgacttaccagctctggaaccttaagcaagtgacgtaacctctctaagcctcagttgcctcatctttaaaatggcatccctaatccttactatgaagagatatcatgggtaaatgagatgctgtacttacgaaagggcaagtccctgtattggtcaagtgtttttacagcattgctgcataacacacagccccaggggctcagcagctcaaaacaagtgtttatttcttgctaataatttgcagtgagctgggaagccttgcctcggactgggggccaggctctgtttgcttctgtgtgtctcattcacaggccagtggttccccggagcttgctcttctcattgtgcaggggtagggtcagtgctgccacccaacaccacattcagttagagcctccagtcagaccaggcatgcactaactctgctcatgcatctctagccaaagctggtcatgtgcacagcaagaaatctgctctgtcctgtccacagggaagtcgcaggaatgtggaaaggccaggaaggattgtgagccaataatacatcttgacaatccacaatagatggaagctattattgattcattatctcaaaatggctccaccagccaaccccttctatccatccccagtgctacctcctaattgaggtcctcgacgctttttgcttgcatggctgccagagcctttgggcaggtctctgtgttgatgtgttcacccccactcctatctcctccatccaacgctctaccaccaaggcaatcctcctaaaacacaaccacagtgttcttcacactccctatgattccctgccacccacattattaatcattaatccaattaataaaaattaatgtactaatccccagctcctcagtgtggcccttcacaatctgcttgtccagcctcgtctcttgcctccccagctttccccagcagacccctctcccacccattccaatgccatcctcttctcccagcctagttctttcaggccctgtgcgtttgcacttgcccctgtctgaaatgtccttcccacttcttcttgaagggggtgagtgccaactcacctttccaaccccacaccaatgcacaccaggatctccccaagactccagggtagtagtcaccatctgtatttctgcagcacactgcacctgcctctagcacagctcgacagcccactgaagtgaatgatctgttcgatcggtgccgacttgcctttctttcccagctgcaaaccacccaaggtgaagtcatcttagcctcttggagtcagcctgactggggtgaacccattgatatgtattgcataaatgaacatatcatgacagtagtgatgagggatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctaggatgatgtgagcatccaaattaataatgataatggtagattatagtctattgaataaaatgggaacctatagctatagaaagaaagaaaagggaaggaagaaaagaaagaagaagagagggagggagggagagagggagggagggacggagggagggaagaaggaagaagactttcttacagtagaatgccaatgaataaatacagagggaataatagaaaactccatttgcaaacatgatcataatagtttattcaaggaagaatcatcactgagtgaaaatttaggaaggtaaagtatgttttcattgtctcatagcacttccactcatatggtttattaattgcaaagagaaaaagtggtaacttaacagtagagaaacccagcaggtcctcccttaatgagctgaacaaagttaacaacaccaggaataggacaaatgggtgccaagtgtttcttgatgtgatacactgagaacacagcattgcttctgtagcattccggtccctggaggaaacatcagacaaacacagatggagggaccttcaaggactgacctgaactgttcttcggcgtcaaccccatgatagacaaaaagaggcagaggaactgttccagattaagggagactaaaaaggtatgacagctggatcaggggaaacgtgccttaaagggcattattgggactgttggcgaaattttaagtgaactgtatattagacaattatcaaggactacacgattgtatggcatcaacctcaaattccccgaacttgagcactagagtcttcttgttctgatggaatatgttctggaatgtttaagggagaggagaaggatgtctgcaactgaatttcaaatggttcagggaaagataatagagtagaatagactatatagatggagaaagtaaatgtggcaaataacaattggtgaaggtgggtgaaggtcatgaaagttctttgccttacaattaattcttctataagtctgaaattatttgaaaataagagaaatgctttcagctgtgaataacagaaagcctgactacttgtggcttttgcaataaagacatttagttatgtaacataacaggatttaagaggaagaaggcaaggacttgaaaaggctcagtgatgtagctgaggccccagattccttttatcattttgtccaaaggctccaccttcctgaatattactgctttatacccttggagcttcatgatcacaggatggctgttatagctccagccatcatgaccaagttcagactccaggaacaagatggaggaagctatgtcaaggggggcttttcttgatgtgtctctcgcctttaaccagtgaagaaaatcttcttagaaggacacagcagacttctccttatgtctcattatccagaagtggaccacaggacagtccctactgtaaactctttcaagtatcaggcaaaaaggaacaaaaggccccagcctggcttaaaccaaccttgagtcatcacctgacactggacactttgtttatccaagcaaaatcaggattttctgttagcaagcaaaggaactgctcatgggtaagaaattaacagtgtgtgccataattcatatttgtcgccaagcatcttctcaggctgacactgtgccaaacaagggattatagagatgaagatgcagcttccatccctgaaagctcacagtccattctctcagggcaatcccggtaacctcctcatcacaatcatccatccagatcatggaagtccctttactccccaaataagaaggagtagcaggaaaaagtgacctcatcaagctgactcgagtttttccaaaagcaaataaataaataaataactttttaacctgcacagccaaatatcaaataaatacatgtgtgttttttgggggggttggggggtgtttttttttctgagcttcctgtggtattgaaactatctcccacttcctcctttttgtctcaaaagatcttaagcattgggccagacacagtggctcctgcctgtaatcccagtactttgggaggccgaggtgggcagattgctttagcccaggtgttcgagacgagtctgggcaacgtaaaaatagcccatctctaaaaaaataaaataaaataaaatacaaaaattagccaggcatagaggtggatgcatgtagttccagctacctgggaggctgaggtgggaggatcacttgagccccaggggttgaggctgcagtgaaccatgatcatcacatctgggcaacagagcaagaccctgtctcaaaaaaaaaaaaaaaaaaaaaaatctaagcatccattcattttagttcatttgaggataattattgatctcctcttctaccaccactagggatacagaggaggagcaaacagacattattcctttctcttgaggctcacagttaattggtaaagagggaccactattcagaaagtcccacacatcattgtatgatcaaaagctatgacagatgcaaggaaggaaagctggatggtgttgtgaggcttcatggcagggacaccagacctggtctagaggtgagggaagacttccctgaggcactggcttgaatggagagctgaaggaggaataggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctggtggtgttttgttttttgtctctaaatatgtgatttagccataggttgatgaatatttttcttggttgagaatttcagaatggcattattattcttaacaaataatattgtttattttacctttcatgctttcagatttcaatatgattaaaggtaatttgatttttctagtgctaattgaaatatttttcccttcctgattgtttactatttctctaggagatatgtagatgtaggtttatctccatcgtagcttgcttagcatgcatagaagttttgaatatgtggattagtgtcttacaaaactctagagaactttcagccaaaataccatcacatattgtcccttccccgttcccttcctctatgagaacactcactaaacacatgctacactttctcactgtatcttccatgtctcttcatgattctgtccacattgtgcctttttttaaattttctgtaatgtattctgaaatatttatgagctctcaccatggccatgtctaatctgatgagttcatttttgagtttttaatttaaaatactatatacaaactacttttcaaatttactacatcaactttttagtctcctaaaaatatattcctttttttaaattttttgaaagcaaatgtgctttataatctaacagtgatatttctactaatgaacctctgtggatctgtttgtactctttttctgctttcctttcaaatggtggaatatcatttccttgcgtacttagatgcctttgaatgacaaagatttatttttctctgaaaattattattgtgcacttttgcatattagtaagaagaaaatttgccaaagagaatttgaattttttgtgagtctactaaaggcaccaccattctgggaccacattatattaattcttggcctaaaggtgtttggacgtatgtttggacagcacatttaaacaatttttaaattaattgctgtaaatcattaatgattgagtttctttaaatctgtcaaatctcaagtcatttttatttgccatttccagggaatgtgaaatgagactaatttacctctgattcttctttatactgaggagataaattttggtgctagctttagggaagagctcctgtgtgatgccctatcttgggaaacactatgtgtttctttactgtcctatgtgatgtatgaccataggaatctgcactcattcattttgctacatgtccgtagggcaaaatcagtatcagtgtttaggtgtattttgtctgctccctgcattcccatggttttgaccttatcttttacttttttttgtgaacataccaatgcttcaatttttttccagtaatataatcaactatactataagagaaaaatttcgataaaacacaaatttcatgttttcctactctaattggcttttacgtaaaaaatacaggtaaaatttatttgtgcttttttgctatttctgttttgctattttctgtttgtctatgtcttcaccacatagacacaattagggaattttgtacactcttgtgccaactgctttgacagtaacaaaatgtatttctcgaactcctaggtataaaactcaagtatccactatttaaattcttttttgctcacttctagtatgtttccagtctcaatagaaatcgatgccaatccagaaatacaagcattattctaatacttctcacacattactggtatggatgacattttctagatctccttaaatactatcatttttcactacttgtatcttaactgttaagttcaacattttctgtaatattaatatattgtgaaaatttcctttctttcttatttgtcccaggttcaatgttttgcagtctctacctcaccctgtgaagcataaacattgtacatgctgtacaaataatacatcgttcatgtacttagagattgcacaatttttatttggttgacaatagctaatgttttcttcttcattttctatttcctgatttttctttatttagtatatactacactgccataaaaataagaacgttttacaaactaaagcaaaaggaaccctaggaataaaatgcacaaataaaatatataaacatacgtttaggtgtaccacgtacacttgtaatttatttagacttttaattttagtacaattttaattaaagtctgtgtattatctgtcatcgtcttagtattttttatataacaaattgtgtaaatcaaaaagtatcaatgtcattgtaaactatcttggcagaggttgatctccaaggaataatttctctcctaaattatgccaatccaaatttcactctaccgtcattcttttcatcagtttcagaggaataataaatttcaaaattgttcaaggtacttcttttagttcaagtaacatttgacaggtgtaaaactgtagacagactgatacaaacgtattctaattgactcaaaattatatgggacctattttaaaatctagattttaaaatgtcgtgtcaacatacacatgttctccttgtgaaataattgttttttattctctggatagaataatttaatctttaaaccttccattcactcttagaaccaatatattacataaggatatgcttataaaaataattcccaactagcttttcagttcagaaatatatgtgaagaatcatcaaacatctaatggatttcaaggagaaatgggttagtaatttattccatatgtctcaatttttcctagactcaaggcttcctttaaaataattgtaggcatttaagaaaccatgcaaactaaaaagaagaaactgtgacgctgccgcttaggctttttaagtctttggacatgattcaatatattttttaaattgtatcttaattagacattgtgagttcaccatcttcctgtcaatacagcatccaagctgattatcatagattacaagttcaactatcaactgtgttctgagagtctaaaaaaataaatgaacgtatttgtttgggtattcttaaagcaggagtgaggacacagcgaaagtgagacaaggaaaagagaacaaaataaaacaggaaagacagaaaagccaataccacacgtgttaagaggtaagttcctgtgttagatatctgggcttaattttatgggaagctatgtggagcatgcctcagaattacatcactgaatccagggagattcttcttagttaccctcaccttttcttcccacttcatgcccagtaacaagctcccgtgctgctagagaaagtcctcagctagaaactggtgcaaattctggagatgagaccttgtagagtgttaagaatggttttcttcccagcagctacagctaaggaataggggctgggctatgaatacatctgctacaaaccaataaagcccttatgctccttttggtgatcgacaatgtatttaaaaatattagatgatcaagaagggctgcagaaaggaggaaacagaaacaaacagcacacctcttggtttattttttttcatttcatcagtttcaaggaaaatatgttgggagttcctggcatagagaatgtcacaaagacatgttttcaatagtagtgctatcccgagggcagagaagacccagagaaagcccaagtggctgctggaacaaaatcagacaccgtgccacctgtccacactccttggctctgccatcatgctgaagatcgctttaaaggactggcttccctccccccaaaattaaaagagcacagactgagaaactgaatgtgggagacagcagtggattatgctgttctcaggggtcacctcaggtttggaagcattctttcaaattaacccatctcaggccatctgcagagaagaaaggtggtacctaactttttttcttgtcggcatttggtaggggtgttttattgaccaaatatgttcccacaacctcgttttttgtgactaactaaatatagtagagttttaaattttatcatcaaaatctatagacaatttttgatgaaaatagactccatctctatgtcctgcttttcttcttcttattaattacattgctgtataaaagaacaagacttcagcatcaagaatatcttgtctcttggcattgaatttatacaaggtgctctttctttaatgctgtctcaaaggacatatttttactcattaaaaaggaagatcggaatctagttgtatgcactgctccaacatattaataattaaaattaggaggtaaatgtggtcaaagctatagaaagactgagatgtcatttacatcgattactctatagcactctacaaacagaaattgttaaataatagtttatataaatattttgtagcatttcaaatatttgagtgcttgaagtttctcctcttttatagttcagattatcaatttgaagacttactccgctagttaatatgtttttagtctcgtctgagtattatataaaagcaattttcagttaaatgtgttccgcttacataaaacgttacaaattattgaggatttaattacttattcatgttcctgtaatgtctttagaagattttcttattattacctatcaatatatgtatgctttgtcaaagaaaaatcaaacatatatatcaatgaaattgaaactttttaaaagtacttattaattctattgaaaaaccacatccataggaacaattacaatataatattgtgaacatgtaaacatataccctatgtctattttatgtataagcatgtatgattaaaaatatagtgaagaatttttaaacctagtattataaagtaaaaattagttaacttccgatgattatttgttaattaagataaaattattttgatttgggtgattttaaataaagaaaaatattaaattacatgacaaaaattctttataaaatgtttatgatttttacattggttttatcacttttcccactattttattttaagatgacctgccttgcttaaaacactgtattcatcttagttaaattagattccatttgtaaaataattaacaaatgatttgctctattgtacagtgcgtttataaactgagtcagtatctcaagatttgatccccattatcatcatctgtggccctatttgttttataaatgtattgtctttttccatgcctgtcacatctctattgctctttcatttttctctttgtcccttatagggagcattgcctatctctagattaagcaaaagttgcatcataaaaaagcacaataacctgctcaatctttctcacacagagaaatgtttgttaagtaattaaagtgtagatgatgatacaaagagcttgattaaattagatgccaaagtacccttgtgattcagaatatgaatggtatttaatttctttgaaatcattaattgctgagtgagattaattaatgccaatattccagaagatgttccagtcagtaaactgtatacaacgtgcaaaagattcagaactctgaagggcaacattattctataattaagaattaagaattaattcacattaattactggggagaaatactttttaagaattaatgactgagaaaatgtttttattttttatttagaaaattattttgtgcatgagcattaccgcaagttttgcaagaaacataaatttaaagaaacaattatgtgcacaagatgaatttaataacatcttgatatattccacgattgcggttttatttggtaaatctttcaaggcacaccatttaaagagaataaatgagtcttggaaatcttgtaggtaagggtaaatattaggatgcatccagttacatttacacacacatacagttacatttacacacacatacacgcatacagactgagtcacgtgtgtgtatatatatatatgaatttaccaattgatgttaactaatatttataagagacagttggattgatatatattgttgaacctgaaaaatatttattatatacatgtttaaaatacagaaataaatagcaattgcactaggcatttgaaactgtactaaaatataagctgtgaacattttgtgatcattacaaattcttacactgaataaatatttttatttttacaatattaatatgtttgatacctgtgtatatttttttacaatgtgttattttatttttgtcatagagtcatgtcatgcataataacattttagtcaaagatggattacatatacaaaagtggtcccatgagattataatagatatttttacatacttttctacgtttaattatgtttagatacataacctcttaccactgtgttcttattgcctgcagtattcagtacagtaatgtagtacacagatttgtagcctgggagaaagaggctataccatataaactaaacgtggtaggctgtacaatctaggtgtttgtaatactctctgtgatgtttgcaaaatggtaaaattgcctatgaatacatctgttaaaacgtatccctatcattcagtgatgtgtgactgtactaaaatgctcaatgtaagtttcaatgacctccataaaattgttgtactgtgaaatacaaatctctcacccatggcctgaatatgtttgcaaactaagcagatcatgggaaggagaatgtgctggcaccgctgggatgattttctcactctacatgaataatatctacagacttcgtgaatatgagccacttgcatagagttaaagtaggcatctctttgctgggaaaattatcaaatgggagtatgaagtgtttttacaagatactcatttgtttgtagctggtaggcctacagtggctcatggtaatggttgaggttgctaagatttggtggaagaaggcaaaatgaaatggccacttatatggtatatggtatatggatcacttatttctgttgagttacaaactcagctggctatttctcctatgttagttatttggagaaaaaaaaacgtgatggtaattttggggtaacaaatacaatatttgatgaaagcaaatttattgagggttagacaaactacaagatactttaggctacaaagtcaacacgagagttctggcccaaattgtgcagagtttgcgtccagctgcacagttcaaaggaagaggccatgtaagaagattctcacttctgacaccaactgccagttcaggggtttcccctgaacaccctcagtttcaagaatttactagaaagactcacagaactcattgaatgccattgtactcatggtttataatagagaaagggtagaaattaggaccaatagaagagacatatcatataaggtggaatctaggagattttgaaggttaagtttccattgtcttcaggacatattacctgtcattgttgtacagcaacaaacatggagtactaccaacctggggagctcacctgatgctaacaagacactatttacaaaatgaaaagacaaaggaaaagatgagataagatgacgttccacattaaggcactggaacgaatagcaaactaaacctaaagcaagcagaaggaagaaaattaaaattagagaaattaatattttataataataatatttgttagtgttgaataattgatattaattcttgactagcttttttaaaaaagagaaatattcactttccaatttattctgtggggccagtgttactttgatacaaaaattagtccaaatagcatagaaaaataaaactactataagtataaatgcaaaattccttaaaaaatactaacaaatcagatctagcaacatataaaagaattatacactatgacaaagtgaaatttatacaagtaatcccaggttggtttaacagcccaaaatccattaaggtgatacatcttatccatagaataagaaaagagaattcatgatcatctcgatagattcggaaaacacatttaacagaatccaaatgctttaatgattaaaaataaaaataaaaactcaatgaaccaggaatagagaactttctacaccagatacatggcacctgtgaaaagccaacagcaagcaggcaacttaatggtaaagaatgctttcccgctatggtcagagataagaataggatatatactttgacttcttctagtcaacactgtactaaagattttatgcagggcaaatcggcaactaaaataataagagtcatccatattgaacaggaagaaataaaactttatttgaaaataacattgttgtatatagaaaattttaaggaatccaccgaacgatagaactcgtaaattatttcagcaatattacagcagacaaggtaaatgtacaaaaatcaattgcacacatctgcaatgaaaaccccaaaatgaatttaagaaaacacttcaatttaaaatagcataaaaaaaagaaatattaattaatttggaaaatgtgatacaagattttactctcaaaattaaaaattattgtttaaagaatatttaaataattagtaaacaccttacacccatgaattggacgatttgatattgtagtactttacaatttgaactacagatttgatgaaatccctgcaagtatcccaacagacttgtgtctagaaactgacaagctgattctaaaatacacatgaaattgtaagggactcaaaatagccaaaataatcttgaagaaagaaaacatattaggataattcacaccccatgctccaaaccttactgcaaagtatcagtaatcaagacaacacaacattgatgaaggaaaaatatatagattgatggaagagaattgagagtccatatataaaactatgtgtctacagtcaatggattcttaaagtggtgccatgtgcaattcaatgaggaagagacagtctttgaacacactgggtcaacaacgtacacgtggatcaccacttgcaaaataataaattagaacccttaccccaaagcatacaaaaatattaactcaaatgaattaaagacacacatgcaagaggtagaataaagcatatgggaaaatcttcaggattttggatctagcaaagaaatagctgtaaccccaaaaacatgagcaacagaataaaaattagatatttaaaatttcttaaaaattaaagacatcggtgtttcagaggacaaccaagcaagtcaaaaggcagctccaaaattgtgagaagatatttgaaaaacacgtatctatatgtctgtatatatatatgtatcttgaatatagaaaaattggtttaactccgtcacaaatatcccaactcaaaactgataaatgataggaatagatgtgtttcccaagaagatacatgaacggtcaataatcccataaaaatatactcaacagcatcactcttcaggcaactacaaatcaaaaccacagttagatactctatggctagaactgaccactttggaaaataatttgatggcttctaaatatatgaaacatagaattgtcatatgacccagaaatttattcctaggtatacacccagattattggaaagaggtgttcaaacacaaattgtacacaagtatttttagcagcagtacctaaaatagccaaaggctgaacacaactcaaatgtcaataaaaatattattggataaacaaaatgttatatccatgaaattgaatgttatacagttataaaaagaaataaagtaccaatacgtacatgaaccttgatagcattatgccaactgaacgaagccgggcagaaaaggccacctattgtacgattctatttagatgaaaacagaataggaaaatctatagagacagaaaacagatttgtggttgcttaggattgagtaggggatgggtgcataggaggttaacagctagggaaggtggggtttctttttgaagtgatgaaaatgctctaaaattcattgtgatggtggctccacttatctgtgcatatactaaaagccactgacttgtagacattaatgtgtgcactctacactatgtaaattatatctcaataaatcctttcaaaaatacacagaagagtaaggggttttggaatgttgcaactgggatgcagtttgaaatactgaataggcctcatcgagaatgtgaagtttcagtaaagacctgaggaagttgaatgagctgatcaatggatatatggagggctatctttccaagccaaaaaattaactagagtcttgatcgtaaggcagcagcatgttggtatgtccagaggacagtgaggtggccaggaccactggtaagatcaagggtgaagatataaaataattttggcggttaacatgcggcagatgatgatgggcttgcagaccattgtaagaaatgttgtttttaatgtacatgaaatggggagacaactcattatcccattatcaatattttaataaattggatccatgaaccaaatccaatgagattaaatcaattaataataatatgcaaatttgtattaaaattacaagaattacttgcacatttgagaacaggagagacatgatttttatcagcaataataaacattattaattttaattgtgatcagctaattgagattaattgcaatacatcttgatttataatgtgactgtcaaaaggaaaatatgattgtaatcttatactacatctatcaatgtcttttattcataagagtatagagtaagcccctagttttcaaagccaacctatgaagcagtgacatcttatgcaagtttgctgctttctgccacagtgatccttggtcagtgggcacaaattgtttacaaaggcccctaggtctagaaatagtttggatcacaatgaacacagaaacaccttcatcccttcagaaatacccatcaattacttccaatacagaatgaaaaactgacaaaggaaatatgtggattgtaaaaatgccagttagcttgcaactacatgaaagaaaaatgccatttttattacattaggtcattgtctcacatgagttttggtatagcaaaatgttgaaccaagggaaaagagagatgaattaatgaagtcttaagatatcaagaatttgaaagaaaaggaaggtcatctttgaaggttagtgacatagcattcatcttcttttgtcacctttcccgtcattccctgtatgcctgacggacaggttacactcaagttcagagaacagcatgcaaaattagctaccaattaatctttaggaagtgagctgcatttctagccagactgagcttacgttttagcaggaagcatttttgggaaatgtttatgttagactttgcccttcttgacaaggtgagacataaacgtctactttatagacatgaattgagatgggaagatatttgggggaatcatttactcaaacgctaaataataaaggtacacaaagggcaaattatactagatttctttcccacttgttttctatgtctcatgcaattcaccttgattcccttcagtttctgtttaatgtagaaagtggcattttcattattttaagcttctagcacaatgaaagaatttctctttttcatgaacaggatcatacacgaaaaggaggaagagtgtcctatatcatatttattgttcaacaaaacactgctccacggcttaaattcagtttaaaaaagagaatttgttgaacatctaacacatacataaaaggcagtaaagacacatgagaagagggcaggatattgaagtatacagacttcaatgctgagttttatatcttaggaagttactccacctgacagaagctcaatttcccctgatttaggaaggcgatgctaatgggtattgcataggtgtaagtataaaaatgttgtatttaagagaatcccacaagcttggtataaggcagaaaataaatagatgtgacatgaataagtagtttattacatttgtatgctacctgcggactagaggaagcaagaaacacagccactatgcttgattagcattatagagatggtacgatgatggttgccagaagctggggggaggaggaaatggggaagtattgtttaatgggtatagagtttcagttttacaagatgaaacgaattatggagatggatggtagggacggctgcacaatgttatgactatatttagtaccactgaactgtacacttaaaatggttaacagagtacattttatgttatgtgtattttaccacaataaaaaaataaaataccttaggaacattttcatgaaaaagcccacataaaattcattttaatgcacgtgtttatgcatagctttctatttttctcttttctctttatattccaaattctaatcagagaagggaatcccctctgtacctccaggatattcagtaaagaccactggaggttcatgccctagtgacagtgctcatttagctccaaattacagatggctctagattaactcaacaaagtttaaagagaagatttaaaacaagacaaatactcatcctgaagttactgaactgcctgtcacaacattattcaaaggtagccaataaaatctagatattcaatagcataacatcaaaatacccaaaaaaaactctgaaatgcaaagaagctgtaagacatatataattaaaatatatattaacaggataaaaataagtcatttataaatgacagacaagaaggaaatttcaagatccttaaagtaaatatattttataaatacatatagataaatacatatatatgtcaaggtacttaaatgaaaattaaatataggagaaaaataaaagttataaaatgaaaaatgtgacatatatagatgaaaaataaatacttgaaataaaaattccatgagatagaataagtaatggattttaccctaacatcagaacatttatagaacaaattagaagcattacaaactaaaggacaaacggtaaactaaaataagaaaaccagaaactcactcataggtcagacaatgtgcatcagtgtaacatacatgtaatcaatatctcaaaaaggatgggtggggtaatcataggtgaataaggaatggtacactcattcctgagggcaccgaggagggaggatagctttagatttctaagggagagttttatccattcatgaaggtccaaccccatgaccaaacacctcccagtgagccccacctgcaacattggggatcaaattttaacatgagattggaaggggcaagcattcaaaccatagcaagagttaaatttcctttttaaaaaattcactgatatgattccatttcgccatagataaaaactagtatttcagcctaccattgagtgtgcttatagctcaccaaaagggcactcagtctcgggaatacagatttgcatagaggtatcctattgcagtcaaagaaagagcaatgagggatagaaaaggttagtgatggagacaccagcgctgcattttgcaacaaacaatgtaaaaactttatggattggttctgttaacttacttcagtttacattcctctcaggtgggagaatcgttgcgttttttcttaagatagaaaagcaattcaggtaatctgaaatctccacaagaaggataagaagcacagcagaaactattctaggcaggaagtcaatcctttcaactgtctgtgctccatagaaaccattgtctgcactgggagtcatatgaggtacagacaacagccagacctctgatcctctcattagtgatttcagaagaaattaccagtcaactgagtaactcactgagtatagtaaacatttggcactgaaagaggttagatgaataactatttgtatcaccatattcatgaagctgaaatatgttccattactggtatcacatccgaatggaagatattaaaaggtctctcatcttgtaagatagatatgaaagaatattttctgagaaatgaaattattaacacacctgcgaggtgcatggaagagaaaaaaaagaataatcaccttgagatcttctccttgataagagaactcactaaaaacataaagagaaaaatacaagtttaaaataattaaccagaagaagatgactctagagattttaaattgctgataagattttaatttgctccaagttgaaaataattatattgcttgtgttttaaggcacataatgagcaattatatcacacatgatagtttcagcagtaaaatagtatccgttaacagctggaactcataaaagcatagcacaatgtgaagatggaatttgctaaaataaaccatctgctgaaaactgctattctgcaaatttaaaaataaagtttaaatgttatttgtcttatttaataggtctgtgaaaaaaatgcgctatttggaaagcagctgctaccttaattaattctttatattagacggctggttacaataatgtacagtaaggtgctacatagatatattgctaaattttctgcatatactatgtatttggcttaaattaattgaaattttattgttaaaataacaaatgtacatttcaatgttttgacacaaattgcaaatatacctttaaaaagcgtcttacactctaaatattatttgtcacctatatatttgtcttttctctataggaaaatttaaatttttcccttgaagctttaattatttgagtctataaaacaaactgataatgtacaaattaacaggaaaaaaaggtttacagatatgtgcacaagtatgcacttggagtttacataatatatataaatatatctatacaaatatttgtatattataaagagatatacaaatatatactctttatataaaaactccaggaaaggcaaggtagtcaacatgcctatgctgtcttgaggttgcagaaaacacagagctgtaggttggtaaatcaggctttgtggaagacaggtgacgacaaggaagaaagaggagcctggcagcagaggtggtcttgttacatggatgaaacctcacagggagcagccctcctcttgggaagtatagataggaaatggcttttagaaatgtaaacgtgccaggctcagttaatcattcctatacccagacaagggagtatctcagggaaagcctgtctatatcaatgcagattttctctacaaatgcaaatctccccaacaaacacagcttttcagctattcttgtagaagaagctatctccagtcttccgagtagccatcgtgaaatatgtcaaaaagctggccaggcgcatgcctgtaataacagcactttgggaggctgaagtgggtagatcacctgaagtcaggagttggagaccagcctgaccaacatggtgaaacgccgtctctactaaatacaaaaaattagccgagtgtggtggtgcatgcctgtaatctcagctacttgggaggccgagctaggagaattacctgaccctgggaggctgaagttgcagtgagccaagattgtgtcattgcactctagcctgggcagtaaaaacaaaactccatctcaaaaaaataatgtattttagggtaatattttgagtatctttacctccatatgtacaataaaaattattgcgatttttaatcttttctgtggagaaaacacaggtgtgatttctagtgtagctgaacatcgtttatttgacagtattgcacttgtgtgtgggtgtgtgcgtgtgtagctactttttaatttggttcttacaaaatgattagatactaacaattaattcagtaaaatgtatgttttgcaatatttctccatgttattatgctttaaattagtttaatcatgcccctataatgtgtacattttaacctttgactatagctctcaatcttactttggttcctgtatttgaatttatgctaataaagtcccacagcttaataagattacataaattttttgtataatttttactagcattctggtgtcattttaaattatgtaatgaaatccaattttaatttggattattgttatctgagttaaggatataaatttttaattttcttataaatattacataattatttctgaaccatacattgactaatctgccctttatatgatgtgtattataagagcttgggatcgtttcatttgcaaagatgaatgcttgagaagtagatatttaatcataacatttcaaaatctactggataacctagaattgaaacatagcctataggttgaaaaactcctgtagtgaagaaagaaaataactaatatacagtgacaatataaatattataagtatttattttattatcaccctgaaatttgataatacaaacatgtaatatctacatatcatccatatatcaggtcataaaatatcaatacattcttcaaaaatttagcataacagaaaatgcactctctctccttgatggaattaagttacaaataaaagtaaaaataagtagataagtagatggaagtagatgtttaaaaacaaagaaaaatatttgttttggataacataaaatctcaattgacaattccaatatttccagaactttgcctgtcaactggtggagagttttccccaggagacatttgtcaatgtctagggttatcgtggggatgtcaagactggtggaggtgtgaaatttagaggtcacaagaaacacctagcattgctagggcagcctcccacaacaaagaatcctctggtcctaaaggtaagtagcaccaaggttgagaaaccataatctagacaggaaacactacgtagctattccaagtgctcaggaaaacacatcagtgccctcgaggggaaaagtgtaaacattttaattgctgtacatggtgacacaaatccatgttgttaatctaagtggaaggggctgaagcacaaaacgtaattcaaagagtttacttaagccacagtgaggacagctgcctggaagaaacagacccaagtatccttggatgtgaactccctttggagctttgcaacaagcagtttcttaaaggtaaaaaagggtccagaagtgggatgatgcaaagaggtttgtcacaaattctcattggcttatggaaataacatttattagtgactggctatacacggttacactattatggggtgtggattatagtgtctggtgtggcgttattggttaattcatagctactgtggcaacagcaagcagcctagatgaacacacagctcaaagaggagcaggacagaactgctgtgtcatttgaatatctctctgggcctgattatttcaaaggacttgcatttctcacatgaaagttattttcttttctccatgtccataaatgagaataaatagacgtaaaatagatcttttcgaggatgaagtaattggaatgaaaaacaaaacccaagctgaccggaaatcattgagggaaaaaaaggatataaatatatgtatttttcaaagtgattttaagctattaggaatcagttaaatgttgggggaatttgtctgataatgggctaaaggagaatgtcccttttgccttctgaagtctccctgaaaatcactaataggaggcagataaatagtagaaaaggcatacaggtttctgcaatgtgtgtacactggaacccttagaacgaagacccagtcacacgatgcgtgcagaagcttatctaccacatgaagtttacagaaaaatggggtcttggatcacagggaaaagaaagaaaaaggttatgtgagaaaacgaccctggctagcaacagtggacttattacataggtggaatctcactgggagtagtcctcagagagaatagacagaaaatgtttctttcagacatttggagacctcagcctctcagttaacctttcctagatccagacaagggggcagacctcagagaaaacctggctgcatcagggcagattctctaccgatgcaaatctccccaagacagctttgcagctaacattgcatttccagcccttctcaatagccattttgaaatatatcaaggaaatatatttaggggtaaaatatgttagtttccttcatacagctataaaacatacaggaataatttttgtcaatgtctactacaaatccaatatagcagtaactatgacacccaccagatattgatgaaaaaatatgtagagtacctcaattacaaatgttgatactaaaatgccaaataaaatacaaataatatccaacaatatttgaaacaattagacaagaaattggcaaaaaaaaaaaaaaatccaccttcgggatgaaagtgtgtttccaaatttggtaatccagtaatattaataatcatattgattagcccaaattaaaaataaataggggattctcagtacatgctataatatatttgttaaaaggcaatattcatgtctttaaagattttaaatgctataaagagtctgatattctatatgcaaacatgtgtatgtccattagaagaagagaggcctgattttcatatgttactacatagagatagagaagtggatacattaatttgcatatgcatagagaaagcataacatagaaattgactatcatattaaaggaattttaattcaacaataaaataattcaaaggtaaaattttagatatttttaacaggtacattattagtattagataatatttataataattgtgaaaatactcagcgctaaaataagatacaatgtctaaacatcagtaataatactagtataaatatttgcttgtttatacaaggaaaattcaagctcgacctaaaattataagggaaataaaagaaaaatattaagggagctctttcacgacataaacgtatatatataaacacacacatataacatgtatatatgttatatgggatagatatagatttagcaggttatatctatatttgtatctgtaactacagctgtatgtatccacatttctacatatttactcagtgatataaatatagactggaataaatataaagacatatatgattcttggataaaaaggatttagtatcataaagacaaattctttccaaattcacttatgaattcacaacaatatacagtttcattagtataatttaatatttctaaataaatttcaagattcatttaaaggaatataaatgtatacaagcagtcaagaaagaagcaagagggcactaaactaacttgctgttaaaatacatttttaaacttagtcactaaaaccgagcagtactgatttggagtactggaatttaggtgtatgggatctcaaaagcacagagctcaaaggagacccctgtatgcacgagagcttaggatgtgctttagaaggcattaccaaaccacgggcaaagttaccttagtgtcttagtcttactaggtttgaaaagccagagaaaagactcaagaccaccatataagagcaaaacaaaaggacagggagagaatgtgaagatactgaaacattttacataaagttgtataaaacatattttaaagaaaatataaagttttggatatacatcaaaatcagcagagccactaaataaataaataggcattgtaaaataacaagagaaaatttaaacggatttctaaaaacattgacacctatgatttttaaaatatgtttaagaaatcccatatttcacagggcagcctttcacaacacagatatgttaggacataaaggtccttctgtttttaatttactagtgtttatagggttacaaatgtcttctacccttgtcttttgtctgatggtgcaaaaatttttcataagcatgtatttctgaatgcctgatggattgacatatataatatgttgctagtattaaaatatgagatggaaaacgcatccaatcttctcactgtttacagaaattctaggtttctcctatttacctcaagcacatatggagcgaattcttaccttttaatattgccatggcattcacattgaacataagttgaactctctcatatggtagctgggttcggattctcttgacaatttccagttctaaccctcacacttcctcagtgtggttggcccagatattgaccctacacagttatctcctcgtggtgactaccagctatggaaccgttggatacaacctacctgactcaccccacagacctcacagcgcacatggacagcccccacacgccacagtaacctgctcgcttgcagtgggagtcaagaaatgtgcctgctggcactcaccccaccgactagtgccccgtggaaaacttatttgggtaatgttctgggccaaataatggctggagtcccacagaccccttttctctctcctgctccccactcatcttccccattttgtttagccctatgaggtgtgctactgtattagtccattttcacaccgccggtaaagacatgcccaagactgggtaatttccagaagaaagaggtttaatagacgaacagttccacatggctgggtaggcctcacaatcatggtgcaagctgaaaggcacgtctcacatggcagcagacaagacaagagagcttgtgcagggaaactcccctttataaaaccatcagatcttgtgagacttattcactatcagaagaacagcatgggaaagacctgcccccatgattcaattacctcccacctgttccctcccacaacatgtgggaattcaagatgagatttggctggggacacagctaaaccctcttctcagctaccctcttctctctggatctgtgagtaataaacctacttctgtgatttcccatgtttggttctgtggcctccatgtgtctgagctgacctacactagaacctaactctcctcctggccagggtctctgagagtggctcttgtcagaaatacacaggacacaggtcaggcaacagtcaccaggcatctcctagtctcaacagatgttctgtgagagggaggcctggtcgtgggatgcacacctggccaccgctggggtaaggaagtgtcctgtgaaaggcacatgttaagcatccacaaccccctgaccagaaccccagaaaggcagggatccaattgacagtcactctccagagacaaacctgaagccctaactggaggaaaagacaacaatgtaaaaagttgaatttatcttactatttcaatgatccagtaaagacattctatgcctgtacaccacatattttcttcgattgtggatttattttagatagaattttaggtctggctttcactttagcctggtccctacctcaagcataaggtaaagattttccatgggttcttttctggtactactacctgccagtgtggggtcatgtcctagtctatcttgagggaatccccctgttcattattgtcagagtgagactgttaagtcttgatttccctgtacaacttcactgcgtgacttttaatatgattttttaatataccctttactggacaataaattctatagttatctgagtaagagatatgctcaggaagaggcattgcctcattcagcttttctctttggtgaactcgcatatgttctcctcacccgccagtcacccctaaaccgtattgttccaagacaacaaacagaactcgagtgtttatctttcaccactggatttgtgtttgctccataaagcttcatgcttaacagagtttctgttagcattttctctatttattttcccataaaatatcacaggccttcttcttatggaattatgggtgatttccttcaatctgcatcatatcaagttgaggttcatgttgatgaaaagtaaaacatacgttgaaaatatcagtaaggatgttttcccctcctttttagcacctgtgcttgtgatacaagcacattttaatacaattgtagtctcatgctttgatcattcctatgatgaaaataacatttttagataaaatatctgagttttatgagggctttagtatgtgatgtgatagaatatcagaagaccatacttttttctagttgtccgtgcaattctatcattgtttcatctttactcctaccagagtaattttccaaaatagatatcttgtcattcttcctgttgttatcagtaaataagtgaaatgaaaagctagattatataatttatctagaacaagaaagtagaattgaatctatattcattaatgagactaactagtcaattacacagacaggcattttacattttgaagatcatatggacccattgtcagaaatattattatttatgtctatatggacatcacctgtgcatatttacatagaaatcaatgatagttgatgtttatttttattatatatattttttgagatggggtcttgctttgttgcctaggctggagtgtagtggtgcaatcactgctcactgcagcttcagcctcccaagctcaagcaatccttccaccttggcctcccaaatggctaggacaacaggtgcacatcaccttgcccacttttttttttttaacttttgatagagactgggtcttgctatgttgctcaggttgcttgtgaactccagggctcaaggaatcctctcatgtcaggctcttcaactgctggtattacaagcatgaaccaccatatgggctggaagctgatttttaaaatactgagatcatatagatgacagcatctgaaaaatagacaacaccaagttttacgttaaaaggtgtgagggtagcaatatggttgtggctattggggaggaaaccattagtaaaaccagtaagttaaagctcttgctttaaactttggctataatttaacaaatgttctatggagtgacagtatgtatgtaaccatgctatacccattcacagatgcagtagagggaagaatttctcaaagacaactgttctaagactcaaattaaaccgtcctgggtttgaaaagagaaagtccaggaattaccaaatattttagatatcagatacaagagaatgccaggtatgcgatgataatcagcaatggttgttcacacaatacatcaaatcagtatttgaattagcttctgaattacaaggacaaatggatcaagtctagactctttagtagagaaatcttatcaggctgagatgtgttttcccctgtttttccacaaggagattactaatttggaaacctcagctgctcttattttatgctctcaccaagccaaaagctgaagttcatcaatcagtgtgtctaagtgttcactggttatataccattttgtagtttcagctatctttccaacttcctaaatcatcaccttcatttgatcttgtttttttccactatcacttctttattgaccatataaagaatataagtaagttcttattttgttattgttcattttagtctaatttcatcaaaagatcacaatcttttaatttcattttaatttcaaagattaaatgaaacctacatagaaatgagtgtaagatttgcatttgcattattttggcatcaatttgctatcctccctcatgcacatagagatcatttccatgtatgtgatttcaaacatccaagggcagtattaaaagcagttgtaaattatggttctcattttcgtgatacaattacaatataaacttcctcttgctgctgtaaccaattaccacaaacttcatatattacaataaagtgaccgttaatcccacagttctgtagtacagaagccttaaatgaaactcgcagggctaacatcaagttttgggtagggctgcagtctttctgagggctatgtggcataatctattacttgatatttttcagcatccagaggccacctttattctttggaacatgacctcattcttatatcctatttttcttttttttttttcagatggagtctccttctgtcaccaaggctgtagtgcagtggcacgatctcagctcactgcaacctctgcctcccgggttcaagtgattcttctgactcagcttcctgagtagcttggactacagacacttgccaccacacccagttaattttttgtatttttagtagggatggggtttcaccatgttagccaggatggtctcgatctcctgacctcgtgataaacccaccctagcctcccaaagtgctgggattaggcgtgagccaccccactgggtcctcattcttgtatcttaaaagtcagtgatgttgagtaatttctcatgccaccacctccaaggttgcctttcttctgccttcttctttcacttaaaaggaagtttgtgatttcattgatcccacccatttaagacaatctctctatcatttttctgcaaccttaatttcacttgaaatctaatttcacactgccgtgcaacctaacatatttgtatgttagactctgggaattaggacatgaaaatttttgggaggccattctttggcctacagcagacataatctatttacctgcagattaaagctttctatatgtttctgactccctctcttaattttctaaaataatattaattgcagtaaagagaaagaaagaaaagaaaacaaagaaagaaaaagatggaaggaaagaaggaaggaaggaataaagaaagaaagagaaaagaaggaggaaatgagggaaggatgggagggagggaggaagggagaaaggcaggaagggagaaaacagaaaacatgaacacaagaaagaaagaaagaaagaaagaaagaaagaaagaaagaaagaaagaaagaaaggaagggaggaaggaaaggaggaagagagaatggtaaaagggaggaaggcaaagaaacaaagaaaataaacaggcgaaggaaggaaagaaaaagaggaaaggaagggagggaggaaggaagaaaaaaggaaagaaagcaagaacgtgagaaagaaagaaagaatatgagaaaagaaggaagaaaagggagggagaaaggaagggagggattagggaaggaagaataagaggaaagaaacaaagaaggaaagaaggaaggaaggagaaaaaaagaaggaaaagaaagaaaggaaaagaaaaaagaaaaggaagaggaaaagaagaaaggaaggaagaaggcaagtgaagggaagagaagagaaaggaagatggaaagaagtaaggaagaacgcaaatgttataaattctgggtttgttagagaatatgccatattgtttttttttcactagaaaggaaagattatctgccattgaagattggatgtcttgttggtgatattgttgttcttaacttccacatgattattgagtttgtgccttgtctttccattactaagacaaaagtgttgaagtctgcaaatataattttgattttttctagttcacctttgatttctttcttgttttacctcatgtatttggaggttctgttgttagctgcataccctaattagtaggatgtttacatcttcttgtatgtaattgatgattctattatgtattatctctcatctctgatactatttcttgttccgaactctgttgtggctaatatcgatgtagtccttccacagccttattttagtgtttccatgatatggctttctccatatcttgatgataacctatttatatctctatatatttggagcaagatataaaatttagacctgactttttaaagatttttcaagatgtaattcttatttctttttgttctatttgacattctctgagtttcctatatttgaagtttgattttctgtcacttcttttacaatatttttggcagttattttgaaaaatatttcttttgctccattatttttccctcttttctttttgggatttcaatcataactagagtaggtaatttgatctcagtcttatgcaggtactttttctcagggtctcaggaatgtaaccttctcacacttctgttcttttcctggctgtgttggtgagctcagtgatattcctccttcaccttctagagcaggtttgttttgtttttcttgttttcatactcccagcatcaggagtattctaagtgtggcagtttttgttgccttcccctacatattaagtggaatatcttgctctatttggactcttataacaaaataacataaactgagtgactaaaaagcaacagatttttttttcacacttcttgaggctgtaagatctcaggtcaagatgctcacaaattcagtgttgatgagagcccatttcatggttcatagatagtgccttctttctatgtcctcacgtagtggaaggcacacaagaactccattgagcttcttttataaagacactaatcccattcatatgggctcgacccccaagacctggtcacctccgaagtgttctgctctccctgatctgtgtcatatacagactctcttgaattccttaccaattgcttgagagatcgcattgagtttgtggggaaaatgttttcaagatggtggatctttcccaacttctgcagctgtcagcggtctcccaatctcaccagccccactttgtctttaggaatttattgattattccagctttacttgtcatagtggtgtctatacgcatctgtcctatgtaagtgcgtctgtcctttttctccttgcaggtgcaagtactcaggagtacactgttgttactaattactcagtattggttggtacattgtcaaagaccaaagaacatttttaaagataaaaaaaagtcttggaggttgtgtaatgaagggttaattctgcagacatggctttccaaaatcttgtgcattccaaaggtcttcaggactggcccttgacaagctcctgggagatgttaacctatgagcccttggtatatgttgcctgatgtgagtctttgcatacatgaaaacgtaggtcatatcaaatagctgatgctaacaacgtgatttcttgtgagcacctgtttctgtatgcctatgactttgtgtaatgccatattaatatgacctctcttaacgcatagggaggttgggaactgagtagctatgttcagtcacaggacgctcgatgcatatgtggcggaatcctaataaaaaccctggactcaagactgactgagcttccctagttggtaataagttcacacatgtctcacaccattgtaaagaaaattagtcagtgtgaagtccccactatgaaaggacacctgtaagctcacatctggtttgtcctggactcaactttatgtgcttttatgcttctgattattttaatctggtttctttcactgttagaaactataaccacaaaaaaaaatcagctttcttgggttatgtgaatcattaagccaaagggggacttggggacccccaataaaatgtatatatattcttaaaaagaaaaagtaaactggctatagcagatattgctgatgacttgtcttctatgtcctggactcaatgtgttcatctgaaattcacctgattccagctaactgagagctccccacatcatgcctgtctttctgatttttgggcctgcctgcaagcttcttgaggctaaccagtgcttctcaaccacacgtaggaacaaagaaggagttaggggtggagagttaatgattctaaggcaatccttaagcaataagagatggggattccagcatccccatctctttgtaaagttattttgacacaatctccatacctccatcattactgagcacacagtagtaactactcattgacactggcttcgtgttctgtttcattttctccacttctgtgctttctcactcaatttctgattaaagtatctgaccccagatatttgtttcatagtctatttttgagggaatccagagccaagacaataacaatgggagctttgcaatgagggagggtgagtataatcatcagaaggttacctacctcactgggaacatggaggcctggagagcttgctgtttcaatgagagaaacatgttgaatctcagttcaatacatatatatatatgtgcaataagacgtgccctttatttatatcaaaggaaagtgctctttacctctctttgttgttgtgtttttatcactattgcctacacaagcagaatatcatacccaggatttaaagccctctctgcaggattttcaagctcatgtttttatcataagtcactctgcttccatgtgttttcaatctaatcctcattcctctgcttttacaccagagaattcatcactgacttatttttgactgacctccttatagagctgtcaagtacacaatttctgctgtgacctttctcttagagttcagtcatatagcctctcactagatatcatttcctcttatctttcctaataatgaattgtcagttaaaactcaacatttttaagattgagcttaccatctgcacacacacacacacaccattattggtgtattctcatagccttgaaacactaatgtcaccttgatgtctgccttttctctctctgctacctcattcctcatccttagattgttctaaaagattcaattagatcaaattggctaattatatttttaagatcctctctacccttcccaacatttcgtttaacaaaatttaaaaatttctggcaggagactgttgaaatccccatggatgactatggttttactattttacctttcagttttaataggttttatattaagtattttgaagtaatgctattgtgtgcatacatatttcttatttacatgacttcttggtgtattttcccctttttcattttgaaatgttattcttcatccccagtgatatttcctgttctgatgtctactttcctcatcacagttttagggagttttggtttgtttgtttttctattgtttggttcaagtaagtttcttataaatctcttcgattccattcaatgattccatttgtttccattcgaagattccactcgattccattcgatgatgattccattcgagtccattcaatgattccattcgagtccattcgatgacgattccattagagtccattcgatgattcaattcgattccatttgattccatttgatgatgattccattagagtccattcgatgattccattcgagtccatttgatgattccatccgattccattcaatgatgacacaattcaagtcccttcattgattccattcaattccattgtatgatgactgcattcggttccatacgatgatgattccaacggattccattcaatttctccattcgattccattccttgctgattccattcaattccattagatgataactccactagattcctttcaatgttgatttcattagattctattcgatgatgatccaatttgattctgttcaatgatgattctatttgattccgttcaataatttcattcaattccattcgaagattccattcgtttccattcgatggtgattccattcctgtccaatcgtttattccattcgattccattcgatgatgattacatgtgagtccattcgatgattccatttgattccatgcgatgatgattccattgagtccattcgatgatttcatttgattccattagatgaggactgcaatcggttccattcgatgatgattctaacggactccatttgaagactccattcgattccattcattgatgattctatttgattccatttgatgatgattcctttcgattctattcgatgattattccattcgattccattcgatgatgatttcattcgagtccattcggtgattccatttgattccattcaatgatgattccattcaagtccattcgaggattgtattcgaatccatctgatgattgcttttgattatattcgacgatgattccactcgagtctattcgatgattccattcgattccattcgatgatgattccattcgagtccatttgatgattccatttgattctattctccgatgattacattcgagtacattcgatgattccacttgattccatacaatgatgatttcgttcaattccattcgatgattccattctattccattcaatgatgattccattcaggtcaattagatgattccattcgattccattcgatgattattccattcgagtccattcgatgatcccatttgattccattttatgatgattccatttgggtacaatagatgattccattcgatgatgtttctattgcagtccactagatgattccattcgattccatttgattatgattccattcgagtccattcagtgattccattcgattccatttgatgatgattccatttgattccattcgatgatgatttcactcgagtccatttgatgattccatttgattccgttagatgatgattccattcaattccattcaatgattctattctaatccatttgatgattgcttttgattatattcgatgatgattccactcgagcccattcgatgattccattcgatgatgattccattcgagtccatttgatgattccatttgattccattctccgatgattaagttcgagtccattcgatgattccacttgattccatacaatgatgattccgttcaattccattcaatgattccattctattccattcaatgataattccattcgagtacattagatgattccattcgattccattcgatgatgattctattcttccccattagatgattccacacgattccattcgatgatgattctatttgagtccattcgatgattccattcgattccatttgatgatgaccccattccattccattcattggtgattccattcaattccattcattgattccattacattccattcaacaatgattccattcgattccattcgatgattacacttgattccacttgacgatgactccacttgattccattcgatgattccatttgattctatttgatgataattccattcgattccattcgatgaggattgcattcaattacattcaaagattccattcgattccatttgatgatgattccattcgattccatttgatgattccatttgattccatttgaggattccactctattccattcgatgatcattccattcgagtccattcaatgattccattccagtccatttgatgattccatttgattccattcgatgatgattccatttcattccattcaatgattccattcgattccattcgatgattccatatgagtcctttcgattattccagtcgagtccattcgatgatcccatttgataccattcgatgataattccattggagtccatttgatgatgattccattcgattcaattgcataattccgttcgattccattcgatgattccctcagaatcctttcgatgatgattccattcgattccattcgatgatgattccatttaattccattcgatgttgattccattcgattccattcgatgatgattcctttcgattccattcaatgatgattccattctattccattcgatgattccactcaattgcattcgatgatgattccatttgtgtccattcgatgacacaatatataattaattaattaatatatataaaatatgtccctagataaatcataacagttgaagaacagaggcatggtaaatttttttgctgttgttttgttttgttttgttttgttttgttttgatacagagtctcactctgtcacccaggctggagtgcagtggcgccatctcagctcactacaaattctacctcccaggttcaagcaattctcccgcctcagcctccccagtagctgggattacaggcatgctccaccatgcccagctaatttttgtgtgtttttagtagaggaggggtttcaccatattggccaggctggtctcgaactcctgaccttgagatctgcctgcctcggcctctcaaagtgctgggattacaggcgtgagccaccacacctggcccatactaagttttttaatgcaatactttatcaaggtagaatttactcttaaatacctcctatggcttatgtgccagaattcagcttgggggagttccttagagatgttctcatagaaatctctacagaagcccccataactccataacttagcatccattctttccatacttactctttcctcttctgtcctgcattaggaaatatgattccctgattcaggatcaggcctgggaactgtctcacctatggcaaaaaatatgagaagggagaggtatttgttatcttatcacctggcatgcaaaagatacagtaaaatcttctgaggatctcctaaggagcaatgacattgactactacttgggacagagcttctgggagcaactcgcccagggaagccagctgacagagaggctcaccagcaaactcagcaccagtaagttggccacagggctttggaatactctcagtcacccccatagttccagcccctggtggccaccacatctccactgtaactttttaacctaggatcctgtttctatttcatttcctggggctaatatagaatgaagactgctcagtggggagcatggagaggaacacacagggctggagatgccatggttacaactatagaaacttcaccactcatggaatgtgacctgtggggcaggggcagcatctatctgatgctaagagggagtaggggacatgagatggaagggccttgttataggaggaagagccccgagctaagaattgcaagacccaagctctagcctggatgctgccaccaacttgctaaatgccttatccttgtggtgcctccatttatggcatggcaatgtacgtgaaggtactccatatatggataaagcgccatgctcttttatacatggtttaggcactggctgcagtagttcaagggctacattggttattattggggtcctctactcagaatttccagagaatatccaaaggagtaaagtaggatcagacttgggagccacctagcccacctcctggtggcagatgcagaggtggggcagggcttcttgtcatctcctcagagaccagtgcaggttctgcatgaaatctgtggtgggacatatgcattggggagctagtttgcaccaggactcggaggctggagtgtcccacagggcatctgggcaagggcctcatggttaatggaacaaaagacattttaaatgttttaccctgatttagggcagaggaagtcatgatggtgaccagcaggtcagggacagtgaggtcacttctctagagacacaagctgaggtctcccagaataactgttctggatgcacacatgaaatgctcactactctgtctccagataggctcctgcatttgtaatgtgggaagtgggaccagcctaatttcttattgtttctttctaaatttggtttgctgaggatcataaaagtgagaaagatcaagctggacttgagccactggtcctcaggtaattcagaggggaatctgggaaagagattgggactaaggcccaaagggtcaagggtggcggcaactccacaaatcaaggggaataaaggaaagtgctaaatgtattgaattcatgcattcattgaacacctcactgttgtttttaactaaattattccttcccttttggtttaatcacattggcacattaattctccaggcttagtaacctagaaacagtctgagctaaaagtgaactaactaggtttcaagagtcttctgccccactaagggtcacgctttcctgctgtgtgtttaataagtagaatgagctttttgcaaagttggcctgccccaagttgggttgacagctagtttaatagtcactcaattgccctgggggaaaaaaggaatcatataacaggacctggtgaaagaggcctagatggtgtagatcacaagaaggctgcagtgcctcaggacccagttctcagtgagttgcttcatataatgatcaatgaaatatgggctcagagtccattgtagccactagttggggttctttgtgtcatgcttgtgtctcagactacataaatgcttctgaaaatatctgtagtgaaggacacagtgttgttttttgttttgttttgtttttatttctaatccatcatagaaacatacatggtctgaattcacttaactatatgattccatttatcatgctcttggatgctggaacaatggtttgctctgcgtttctcaatgcttgctttcaatttttataattgtcttgttggagatggtaacaaacagttcgcaggctgcaactgttccagggatcatacattaagcagcagtgccttaaaaggagggctagctatgtctttgcttgtcttcggcatattatgtggccagagcactgggtagctattctttctccatctacaccccacctacgctccatccctaagcagaggtgggttatttctattattctctgcaggcatggtccccttggcttacttggcttttcctatgagccacagtcaggacaggttggtttgggcgaccctggttttacctgttgtcccccttctccccaccaggctcagcagggagctgcaggagaaggagaaagtgattgaagtcctgcaggccaaggtggatgctcggtccctcacaccctccagcagccatgctttgtctgactcccactgctttcccagcagcacctttttcctgtctgatgagctggaagcctgctctgacatggacatagccagcgagtacacacactatgaagagaagaaagcttctcctgctcactcaggtagcctccactttctgggtggtaccatctttgtctagactgagtggagaactcaggaaacaggacttatagctccatcatggtgtgtatcaggctgaacatggctgtggggccaagtgtcatgcacaagcaccagtggatcaggatctttgctctaatcctgactctacaagttacccctgtcaccctggcctccatgggcttgtacatgctgttgggcacaaggtgagccattgtggggagagtgagaagatcacagccgactcttcttcctcggcgactctgtcagacagatcttctttaagatggaaaacctccttcacctctcctacaatgatcttgctacttattcctgagcagtgttccctaaacatatgtgggtgtacacaaatgctgctagtcttgcctgataattttggagttgtcgttttcatgttccagagctcagagcaccactgtcgtccctaaggtggtttacctcactatagggtctgtctgcaagaaagaaaatgaacactgctaacagtgcttgtgcttggttctttccctgaaagcaagactctagccctggtacccctggctaaatataaggccaggattccagttctctgtagaacatcaaacgttttctttcattcatgggttttatagattccatccatcatttgagtcattctgctgtattgtcttctaaaccgtcatcaaccagtgcatctctgggggctaaggccaaatccagcagcaaccccatcagcttgccaactccccagaatccccccaaggaggccgaccaggcccattcaggtatgcaacagccaatggggcagaagcttcatctcctctttgatttttcttcaaggacagaggtttggactgttaggggcgtaaattcatcaaaacctagacagaatcaagaaaccaccctcattcaccaattgtgtctgatttaagaaaatattttagaaaataagtaatccacatcaggttttgatccgcacaccagctttgaccagtagttggctgaccatttaaaaagaaacatttttattggttttctctcattttatcctgggaggaaagaggaaaaatgtttctcccaggattacaacagccataggatgaaaagaaattcacatctactgatccactgtatgtgttacccattaaatctgcatggagatcctccccaagagacagtgctacttatttcatagccaaggacgctgagaacagcctcagacaaggttctgttcatagtacattaccattaatggatgtatgaatggattggcagtccttgatatgtacgtagtgcatatcttgggggcagttaaaagggtgcatttcatttacaagtccagcttagttgccagagggtacactgctcattcacagccctgtaccaggggtggcaaggaaaaggcaaaccttgtcttcacctcctacctcccaccatagctggctggctgccttcagtatggtttgttgtgaggtttgacttgagtagaggtgctcccagaaagcacagtgctttcttctgctgccctcatttccctgaaggcaattcaaccaaaatcttaaagaagaggaagtgttccaatgcttcctgagcctggtttcaaagtttctaggccagagtgggcagcagctggaccagaatcatgaagtaaagctttgcttccagaattgtagacatctgcttaaatgttttgggttcaaacagagcagaagatgaagaatggaggatttaaaaatcagaatgcctcctcaaagaatgtctgggctgtgttacctggcaatttgagtgtatttgcagttttgatctgaaatggtgtcagcactgttgggttgtgttttaggacgtaatcattgtcttctacattagacattctctatgggtcagccttggtttctgccccccaccattggctacctgccctttaattgcttttagggaagaggaaacaattttaaacattgaaacttgacagggcttctaaagatctatctgacagagtaaccaaggaagaagagtctgctgtgatcttctcactctccccacaatggctcaccttgtgccccacagcatgtacatgcccatggaggccagggtgacagaggtaacttgtagagtcaggagcagagcaaagatcctgatccactggtgcttgtgcatggcacttggacccacaaggtctctaaaaacttgtctgtaggtgggctgcctaaagatcaccagggaagactttttttaatacaaatttcctgttccaagaatttataattctgtaagtctacattaatgcctagacagaatcaagaaggcctaaagaatctacatatattaagagtttttgctatgtgatttaaatgcccagaagggtttgcaagccattttgtctaagccactctaccaaggcatctatttttaatttggtgattgaacacgttgatttggaattctgaagtttgtttccatcagagtcctcaactgcatgcactagtaatgaaaatttccccacagcctttgttcatctctctcctactcaggatgggacctgatgccatcagagaggagttctaggtggagaaagagtcttgtcccaaggccaaggactgatacatgctgggagcagagccccaggggcccttgagagcattcaggctctctgacttttccatgcccaggattgctggcgtggggctcaataatgccaccttaccttgtttagccaattgctttcaagatgaacacagaggttgtatgcaggatagccctggcaggggaaaagagggaaggtcagccaggccagattctctggtagcaatggtcactcttggctgtctcatcctgtaccacactaggtaatagccactctgcagggtgatgtctggttctcaatcttttgctcattcttttctctcattttgatgatgtgtctcttttctccctaactttctgtttctaggcattttcactccatacccaagctgactagacttcctcaggcaccattgccctcagctccatccagtttcctgcctttcaggcccactggccctcccctccttggctgctgtgagacaccggtggtctccttggctgaggctcagcaggagctgcagatgctgcagaagcagttgggagaaagtgagcacttctgcatttgtgtgcttgtgaatggcagccccacactgtgttgctctgcatggatcgggctggatggcagagttcaaagaaacaatatggggacatgttacaaatggaagactgagggaaagctctgcttgcttattttttggaaatgtatttcctgttatttctctgatgtgtgtctcatcagttaacaggtagatatgttcaagaggctctagacctggtgctttcacactgtagatagtgtaggataccaccaagtatgctgaatccctgacagactggtggactgctcattggtaggggatgggaggagatgttatgctttgcctatgcaggatgaagtggccaagaaaaagagggccacattcagtgggctcctttgtgtggctattacacttttctgctgtgaaatgctgttaatcaagttcagttcctgacatcattaggttggagcaaaaagggtaatggtaccaaagtgtcagctatggcatctgactgtgaatcctatcttctgactcccaaagataattgaccttatatagttatgtagactgtggacagtcaccttttagaaaatgctagatatatttgtaggctggatgctcatcataaatttagtatgctggtggtcattgatagcttaaaaaaaaagacaaaccttcacatgaatttgctctctcgtagcaccttaagcacaacagttagaaagcagtttgaatgaacttaaactcatttgtcaggcactttctgtgcctgcaaagaagcttaggtgagccagagactgatagggtcaccatgccagcagtttctagtgaagcaagacaacagccaagaatttgcatccccctccctgtagccctaaatgtcatgtggaccaacctatttctttccttcttcctttctttttttttttttttttttttttttttgagacagggtctcactttgtcacccagactgaagtgcagcggcatgatctcggctcattgcagccttgacctcctgggctcaagtgactctcccacttcagccccccaagtagctgggattacaggtgtgtgtcaccatgcctggctaatttttgtattttttgtagagatggggttttgccatgttgccaagactggtctagagctcctgagctcaagtgatcggcccacctcagtttccaaaagtgctgggattacagacatgagccactgcacccagcctagcctatttattttgtcaacccagcaaatggatactttgtctagtgcagggaactctaaagctcagggaagtgaagttacttgttcaaggtcactaggtgggagagatgggcttgaatctggtcttccgctccaggtttcacgtttctgttataccttttctgcttaggatggctttgtcaccatcctgcttagagtatggggctgagatcagctgatcaaactctggggaatccttgcaacaatttttttcctctctttagagaccagtaggaggtgctggtgtttctgacccaaaacttgttactttagcagttgtggcaccagcaatgggtgggcaaaaatgtcccccaagacaaatggcaagagtattttctagtttccatttcttcctcttgcctccttttcctttatctatccacatttgtccatttgtctttgcccaaagggaaggatggaaggagagcactgtccatgaaaaagggtctattgttttgggttaaattggaattacgtcaagtctgaggtcattgactggagatcaaatggtcccagcctagatgaggaagattgtagccctttctttctccacctgaagtcaaggtcctctccaagggccattgcttatccaagctcactgtttgcgttgagccaattttccgtgtggacagtggtgcatggcggcctctcaggtccctgggttaaaatcttgtgcaagagtctgtatggtatctttgcatggtttagagcatgtactgtgtattgtgtggccaatggactggaacatgagaatactgatcattgttactgatagacttaaaacctcacatggccttgattaaaaagtaagctgactatctacaaccactgatttctccctttgccttgtgtttggatggggttgaaggcagtttgaaagaggcaggaaatcacgtatttgttgcatcccttcaaaaatgtaggtgcttaaatttttaatcttcttccttaactaagtgatcctgatgaatatctagtattttgcaaattggaggagagactcatcacaagacttctcaaacttctgcctgttagaatcacctcagtatatgtttccatactttctcagatgattccaatatgtaccaacatttgagaaccagctacaaatggggctaaaagctggcaactggcaattacactaacccctccgaggagtttggcttggttggaagaaacaatgacctcactcctgttgcttaggaggagctacctgtctattctgctgcccatgttcataatccctgaaagaaagcaggcttctgaattttctcctaaattgcacttctgcccacctctttccctatctcctctatgctgggcttctttttacagagaagtggagatgaaggggctcaagggaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaatta

SEQ ID NO: 1094 - DNA, 40262 bp, Homo sapiens
taattttaaagatacataaaaagggttttatttatttaacaaacagacaattgaacaaacaaacaatggaagcaagtcatttgccaaaaggaacacagagggtcatgatgatctactcctccaaggatttcagggttcccagacgcctagttttctgtctagttctggaagatgttattcttggggagcaataggtcctcgagtttggggctctttcaggttctctctccatttccccattctgctacaatagataaacaaacaaaaacaattctcacttccagaagatcccgcctgtacgtctgcacgagcccttcaggaggtctggatgtctggttcacaactcccctgcttcttttccagcttttgctttcccttcccccgctcccgccctaccgccccacgacccgaccaccgcccagctgagccccagaggctccacagcgcagaaggtgcaccggaggtcgtgtcagttgcccgccccgcggggtgccaagaaatcaacgctttgtaaaaagaacttccccgtggaaaaaaatctcttgatttccactctcacctctcttcaaaggactaaaagctaaaggcgacaagggattcattcgacaagtcctagtcgtgcgcccttgtgagtgccagaccctgctccctgccaggggacccacgagcgaccctcaccaccatccctgccctggtggagccccgggcggaacacaggatccgaagatggcagcggaagctccgcagcagcccaacagcgactgggcagggtggatacaggctccttcactgggtgaaggcggcacaaagaaccggaagaaccatcccgggagcccaccgggcgttcagcttcccttgggaccccaggcgtctcgggctgggtcgccgaccggggcgtttctggggtctctccctctggctccagaatctcctaacgcgcaggtgtccaacgtgaccagcgcgattcaccgctctaatatctctggttttccaagaacttgctcagtcgtcctgccaggcgggccctgggaatagaagggacagaggaagtttagtgagtgcgcccttcctatatggcccagtggagttagcagtgcttgtctctgtggtgcaatcggttagcgcgttccgctgttaaccgaaagcttggtggttcgagcccacccagggatgcttattggaacttttaaagcatgcacgtattgtcaatcactacataaatggggaagaattagccactaatttatgactgatccatgtcaagggccagccagctccccgaccagattcttaatcgggtatctcctgaaacggcgggtttacacctgtgtaactcaggaatcctgaaacagagacctaggaacccacttctggtgtgataaaattctaattcagtcgattatacgcttaaatgagtaacttacttgtctccgttttttcatattttagtaataggagtccagtagtatctccaggatgtgcctggatttactgattggtctatcaataatgtgaccagtggaatcattcatcatcatagtgatcctctccatcatttttgaaaacagtatttttcctcagtttgtgcattatttatttaacccttttcaaaatgtttttgttagccaggcatggtggcatgtgcctgtaatcccaggtacttgggattctgaggcaggagaatcatttgaacctgggaggtggaggctgcagtggaggctgcaccagtggaggctgcaccgctacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccagtagcaatatttataggaggaaaaatgtgcagaagtgcaattgagcttcgtgcctctccatggggcccatgttcataaaatggtggcattagcaatcatctgagagtggaggagtttgtggccctctgacatcaaaagctgaagcagaggacatgaaaaccctcactgtacatcctctgtagtctggccagaatcattcctaggtcagtggtctcttatcaggagggaatgctgcttgcttgttttgtcaaaaccacaaaagggagggaaagtttcaggccattggttgataacagtggagaggcaagtctttccaaagggctggtttgttaacccttaggaaaaaaaatcctaattcttaccagatggttccatgaagttccaggcttttggtgtcccaaacaaagaactgtacatgacacacataaagcagcaaagcaaagcaaaagtttattaagcacagtaacactctcagagtggggagagtctgggagatgagatcagtattagtttggtgtactttgggtctttttatgtgtgtttttttcttctcttcacagggatgcctaatctttagccagtgtttgtcttttgattgacaggtgcttagttactttggcccttgtgtgcttgcacgttgcctccatcccataattttaagtacatgcatgatatgtagtccatatgcatgagttttaatgagctgattatcatatgaagtcatgttaagcatactttttctctctaatgcacatgcctgtctctgaggagctgctcctttactggtttggatcttgcaggccatggggtccttgcttgctgttttttgtttttttgttggttttgttttgttttgttttgagacagagtctgtctctgttgcccagtctggagtgcagtggcacaatctcggctacctacaaccttctcctcccgggttcaagtgattctcccacttcagcctcccaagtagttgggaccacatgcgcacaccaccaaccccggctaatttttttgtattttaagtagagatggggttttaccatattggccaggctggtctcaaactcctgacctcaggtggtccacccactttggcctcccaaagtcctgggattacaggtttgagccaccaagcctgatcaaaaaaagattttttaaaattattcttttaggccagtcgaggtggctcatgcctgtaatcccagcactttgggaggccgaggtgggctgatcacgaggtcaggagtttgagactagcctggccaacatggtgaaaccccatctctactaaaaatacaaaaattacccgggcatggtgtctggtgcctgtaatcccagctactcgggatgctgaggcaggagaatcacttgaaaccaaaaggtgaaggttgcagtgagcagagattgcaccattgcagttcagcccgggcaaaagagcaaaactctgtctcaaaaaataaaataaataaaataaaataaaaaataaaataaaataaaataaaaataaaataaaataaataaaataaaataaacaataaaataaaaattattcttttagccgggcgtggtggctcacgcctgtaatgccggcactttgggaggcccaggagggcggatcacgaggtcaagagatagagaccatcctggacaacttggtgaaaccccttctctactaaaaatacaaaaattagccgggcgtggtggcaggcgcatgtaatcccagctactcaggaggctgaggcaggagaatcgctggaatccgggaggcggaggctgcagtgagccgagatgacgccactgtactccagcctggcaaaagagcgagactcgtctgaaacaaacaaacaaaaatattcttttaaacttgtgtcatggccgggcgcggtggctcacgcctgtaatcccagcactttgggaggccgaggcaggcagatcatgaggtcaggagatccagatcatcctggctaacacggtgaaaccccgtctctactaaaaatacaaaaaattagccgggcgtggtggcgggtgcctgtagtcccagctactagggaggctgaggcaggacaatggctaaaccagggaagcagagcttgtagtgagccgagatgtcgccactgcactccagcctgggcgacagagcaagactccgtctcagaaagaaaaaaagaaagaaagaaagaaagaaaaatgaggaagctactgatagtccagtatggtatactgtgacagattgaaaaaaaaagtggttatattttgcagcttctctcatcaagagagtctatttctcctctctttgaatcttggattggctatatgacttgctttgggcaaatgttggtgccttcgcaaacctggcagaagagaggcttgcacatgggaggattacctgcttttttcttcacttgaaatcctgaggccatgatctgaagatcccccaaagctagcctgctagagagatcacatgaagaaaaagatccatgcatcccactttttccaaccaatccacctataccccagatgtgtgaggccatcctagaccatccagccccaaatgaaccagcttggactagaagaatttccaagccaactcacagaatcactaaaaataataaattattgttattctttttttattttttaagagacgagatctcagtctgtagcccaggctggagtgcagtggcatgatctcggctcactgcaacctcggcctcccgggttcatgccattctcctgcctcagcctccctagtagctgggactacaggcacctgccaccacgcctggctaatttttgtatttttagtagagacggggtttcaccgtgttagccaggatcgtctcaaactcctgacctcgtgacctgcccgccttggcctcccaaagtgctgggattacaggtgttagccaccacgcccagccaattattgttattctaagtcaataagcttgggatggtttattatacagcagaagtgtatcaaaagggtgatggtagttgcaggaaataaatatatacctttaattgtatatgcataaacatctttggaatgatacctccaaaatacaaattcccatattgaaagagcacactcagtacccagcatggtggatggaaatatatcatgaagtttcaaactaataggaagaggtagaagattctataggcttttgggaggggagatgggagaagagtttaaggcaaataacaaagaatcagagcggcatccatcttctctatggtgctgatgtgctccagtgtataaccatcaggaacaaacctatagtcaaacctgagtatattggctcattgcaacacaggagacagcaaacactatggggaaattgtggggcaattcttcctttgggaatctcggtatttttatctagaaagtgggagaagtggttgcaagactaaacacataattggtaaagaatcaacagtcaatacaaaagttagccaagtatggttgggcatgcctgtaatcccagctacttgagaggctgagggaagagaatcacttgaacgcaggaggtggaggttgcagtgagctgagatgacgcccctgcactccagcctgggcaacagagactgtctcaaaaaaaaaaaaaaaaaaaaaactggcctggtgcagtggctcacgcctataatcccaacactttgggaagctgagcggggcgggggtggatcacaaggtcaggagttccagaccagcctggccaatatggtgaaacccagtctctactaaaaatacaaaaattagctgggtgtggtggcaggtgcctgtagtctcagctactcggaaggttgaggcaggagaattgcttgaacccaggaggcagaggttgcagtgagctgagattgtgccactgcactccagcctggtgacagagcaagactccatcacaaaaaaataaaaaataaaatcattaaccgtcactattagtagctgggatgtttgatcatattatggtttgaacagtgttctttttatgttcaaatatgattgtgaaatagtatttctttcagtttagtgagagggtaactttgtctgatattggtgttgtgaaatttttcgttttaaccatagaacaccatggcctaggtgtttgtcagaccagctctagctcagagcagaaaaggcttacctttttctttctcagaaatgactatggaaaacagtaaacaacaagggccgggagccatggctcaggcctgtaatcccagcactttgcaaagccaagggaggcggatcacttgaggtcaggagtttgaaactgtagcaggagtcatagacaaaatccctcagacacccgattgtggaatgtaagagcttttttcagctgggaccatcggtagactcacatcctagaaaccgagctccccaaataagtaattcttgtcccttttaagggcccacaactctaaaggggctgtgttgggggggtcatgatcaactgagcaagcaaggggtacgtgactgggggctgcatgtactggtaatcagaatgaaacaggacagaaaagggaatttcataatgcttttttatacaatgtctggaatttatagacagcacaatcggtgaggtcagcggttgaattttaacaaccaggcccgaaatgtggcacccagttgtctgagcgtgattttcacttctgcccattctttcaacctccactttttcagcaaacaagaaattaagtgtaagacaatatgaggagtggtcgctctcaaaaccagcttggccaacatggtgaaaccccatctctactaaaaataaaaaaattagccggacatggtggcaggcacctgtagtcccagctactggggaggctgaggcaggagaatcgcttgaacctgggaggtggagattgaaagtgagccaagatcccaccaccgcactccagcctgggcgacagagcgaggcgagactctgtcacacacaaaaaaagcagtgccttcaaaaatctcagagagaaattatttccacctatctttttgtatctctatctagtaaaatatcaattaattttatgggtataaaagacattttcagacatgcagtgtctcaaaaagtttatttctaaggtaaccactttataggaggttttggaggatatgcatcatcaaaaggaagaagtgagtgaggaatgaacccccttgagatccatgaagcaggggatctaacaagagagaggcgatggaaatcccaagatggtgcagtaaagagagatattatgataacagctgtgggataagcctgaagagcaagtcatccagaatggaacatatagaaatgtgccaggaaaaatttctttctttctttcttttttattttttatttatttttattttttgagaaggagtctcgttcttttgcccaggctggagtgcaatggcgtgatctcggctcactgcaacctctgcctcccgggttcaagtgattctcctgcctcagcttcccaagtagctgggagtacaggcgcccgccaccatgcctgactaatttttatatttttattaaagacggagtttcaccacgctggccaggctggtctcgaactcctgacctcaggtgatccacctgcctgggcctctcaaagtgctgggattacaggcgtgagccaccgtgcccggctgctcttttttatagacgaagaaattgaggtacagaaaatccagtaacgttttaaaagtcacgtcatgaatgaaccaagatttcaacccagaaattgaggcttcactacaagtgaagactggggttttcttgttttcaattattgggagttttggatttccaggaatgtgcaattgtaaaaacccagcttcaagaggtgatgaaataggtgcagtggctctggcgtaagctctgaagccccaggctcaggctctattgaaaaattacttttgctgaaatattcctgtttttaggaacttccatggaacttgagccttcacgcagcatattttggcatctgattcaaagctaatagaggtccggaggattcccaggattaaagtctttaaacagaaactgtgaatcttgcctaagcaaaaggtgccatccctggatgggcttgcaccaccaacctttcagttaacagtcaaacgcgctaaccgattgcgccacagagactctaatggcttgtgtcttaaactcatttgctgataccagaaatggctttttaacctctggctgcagataatctcatatatttgatgcctgtccaatcccgcgcactccagaaacccagaatacgggagacaatgaagccaagagtcgagtctttgggcactttggacgttctacccgggcagagtcagctgggggactccaacggccaaagggccacctgctcctcaccgtctgctcttcactgcttcccccgcctgctcttcaccctctcaaaagtcgctggcccctctacaggtgacaactgcagcttctccggcgaaagccactcgctttcccattcttagccccgctcacaccttgcgctcacagtcatttccgccaggcctgggccagcggacgcgcgcgtgggaaggaccagaacccgtggtgtcctcactgcgtccccctcgggccctcagaggtgggatccacaggaaagggacctggagtttgcacaggctgcagcccttcgcccagagccaccctagcacctagtaggtgcccaataaatgctcagtgaaggaaggcattccaccgcagggttttaggagaaccatgaattcctggatgaacattaagcgtttagtcctactaggaagtctggaatatagagacttgaactgtttctcaaaggcagctgttcttgtatccccagagccggtttagaatccagcaaaggcccctgcccggtgtatcccacctctggagacccgaggatagtgcggtggggagcaccgcgggttctggtctttcccacgctcacgtccactggcccaggcccaaaggaaatggctgtgagagcaagatgtgaagatagttacaaataccagctagggccagtgacagttgcagaaatgaggacttgtaatagttaggagtatttcttcattattttgagatgaatacatttggttatatattaaccaatacttttcttgagaattctcatcttccatcatcctcgctatcatattcattaatagttaacttttagaaatctcaatatttaggttacaggatagcaaatatggaatgtgatctagctaaaaaaggagtgaacatcattcaaagacaaataaaagactttatcctgttggggaaagggttggcatattttcactgaatgagaaaaagtatgattttcctattgtctttatttgaaccttaagtatggctttacaaggaggaaaaaggaggaagaagaagagaaagaagaggatgaggaagaggaggaaaagagaaggaggaggaggaaggtgcacattgatgccactttgagaagaagtggactgtggtggatttgtaatgtatcagttttgccaagctgaatgcacatttcccagatttgccatctttagatagctctaggttagcctgggcaacaggagacacttggaagatagaattcaagtggctgttacacgcttttgtatactgggaagggcgttgttacagctcaggcatgatcttcatcttccctgacccttggactggtgggtgttttgcttcttgatctaacattaaggttagaagttgcaggatcccagctgggttttgttacatccaatctggtttaagttcccatattattaggaaagctttagggtgcttcaggaaaacgctttttaaaaaatcagatttggaaaatatcaaatggaattacaggcaataagcataacccagtggaaacatgaatcaaaccctctagagcagggttgtctaaattttgggttccttgggccacactgggaaaaaaaaaaaaagacatttgtcttgggcccagcataatatacactaactgcaactgaaccgtgcgtgtaaagcttgtaaacaaaatctgtctgtaaagtctgtaaacaggccaggcgcggtggctcaggcctgtaatcccaacattttgggtggccgaggcgggcggataacttgaggtcaggagtttaagaccagcctggccaacatggtaaaaccctgtctctaccaaaaattcaaaaaattagccgggcctaattttttagtggcctgcgcttgtaatctcagttacttaggagatcgagtattctctggctgaggcaggagaatagcttgaaggcaggaggcagaggttgcagtaagccgggatcccgccatgcactccagtggactgtttgctgttaataaatgtttacaatgggctcccgtagggaaaagaaaagcttagttttatttctatagaacaaaaaaaaaagttaagagattagtagagacgggtccaccatatttgaccacactgacatcaaactccagagctcgagcggtattaacataaagttatcaatgcatctcacagactactgagattacaagcgtgagaaccaaccactacctggcaaaatctttactttgaaagtaagttacagatgggaacaaagacctgtttattagtttatactaacgccttgtatatgcttccacagcaaacaaaatccacttttaaaacgacaacaacccagggaaaaacacagacacagttccccactgccacaaattatgtaatcaagattcccacattcggggaaatcacaggggtcagcacatccacagtaaaactgctaagccttgctctggaaaaaccaccttcgtgatcataacatttcttctgccagataaacataagtataagctcacgcccctccgccccgccgcagcctcatatgcctcaccctttacacgcaaggtcacttgcgtcacgcgcatccaggagccatcctagccctaacacacagctgcgactctccggtccgaccagaggtcccagacttactcccacggcacgggaactctttcgtggcgaagcagcaggtggcgaagcagcagcccctgcgctgcctcatctacatagaaatcgccctctccgtgatgtcaccgacaacgccttctggatccccgtctgctcttccgcctcacccaacgcccctcagcggagcaaccagctgtcggagccggcgggagaagtgacttatgcctgtcccttctttctctcctgtccccgcccctcgtctcccgcaatgaagcgagtatttaatctgtgtcctgtggaagtcccatttggcggccagctggaagcccgtgcacccttcttcaaataatggctttcaatgagcagactagaacgtttaggattacaaaggaaaccgattcctttcaaacttggttatctttgtgatgtggcactgtgtgcatatcttcgttaaaacgcattgaaggccactgcactccaccctgggcgacaggaggtgactgtgtctcgaaaaaaccaaaaacactcccccctcaccccaaagcattagacgtcaaggctggcagggatgtctgttctcttgaaagttcaatatcaaaatacttggaaattaaactaaaatagtagaagcaagaacaaaaattaagttgaagataatatcaagaatatttcccacaaaccaaaataagaatgtaaaaacaggagagaaaagttcaggaagatagacgtccaaggtccatatgattagcatgcgtatcagaaagaggatagaaaaaaatcagtacaataattcaaaacactttccataccaatggattgaaactacagtgaatttaaagtattgaattgatattgaactttcaagagaacagacttccctgccagccttgatgtctaatgctttggggtgaggggggagtgtttttggtttttttgagacacagtcacctcttgtcgcccagggtggagtgcagtggccttcaatgcgttttaacgaagatatgcacacagtgccacatcacaaagataaccaggtttgaaaggaatcggtttcctttgcaatcctaaatgttctagtctgctcattgaaagccattatttgaaggagggtgcacgggcttccagctggctgccaaaggggacctccacaggacacagattaagtacccgcttcattgcgggagatgaggggcggggacaggagggaaagaagagagaggcataagtcacttccccgctggctctggcagaggtttggtcccctgagtgctcctttcttgtaagcagttcttgtttcatattttcactatctctgacactattaactgtacaattttttttcttctgtacacaaaaaaagtttgtttcaatagtgaagtatgagtcagggtggtggctcatgcctataatcccagcactttgggaggccaaggcgggcagttcacctgaggttaggagttcaagatcagcctggccaacatggtgaaaccctgtctctactaaaaatacaaaaattagccaggtgtggtggtgggcacctgtaatcccagctatttgggaggctgaggcagcagaattgcttgaacgcaggaggcggtggttgcagtgagccgagattgcaccactgcactccagcctgggcaacagagcaagactccatctcaaaaaaaaaaaaaaaaaaaaagtgatgtatcttctacagtatactcttccaacttatcagattctgtcattgacatacgatgttgcatcaatacttgtgtaaggggtttaacactactactatatataatatatgtaatatattttatatatatatgtatatatatatataacactaaggtttattaaaacaactctcagtaaacagatgcccctgatgttccaacaaaataacctactattattagaaaccaaataaactcctcctcctatgaggaagaaagtaaacaacttctggcttggcgcggtggctcacgcctgtaatcccagcactttgggaggctgaagcgggtgctcatgatcacctgagtttaggagttcaagaccagcctggccaacatggtgaaaccccgtctctattaaaaatacaaaaattacagcgcgcctataatcccagctactcgggaggctgaggcaggagaatcacttgaacctggggggcagaggttgcagtgagccgagatcaccccactgcactgcagcctgggcaacagagcaaaactccgtctaaaaaaaaaaaaagtaaacaattctggaacagtttgaaaaagcaatttaagtgaaaatgaaaccaaaaagggtaaaaagaaaaaggagggaattgtaggaaataacctatatgtgattatctattttcaattctaagtggcttggtataggtttaggcaggctacctggaaagaaagaaataaagaagcagaatgtactgagccaccccctccaccttccttctttccctttcacccagtggccaggcatctatcggtgggggctccctcatctaccccttccccactccacaaagaaatttagtttaagctagcttgcaacatagataattgtaccctttcttatcagctaagtgcagccactagagctgtaagtcaaatgtttgaaaaatcctgagagtcataatgcatcgtgtgctgcaataaaatgcagcagaaagaccctaaagaatgtacttgaagaacaatcaataggtgatgtctaggaagattgtggaaggctagtactcagcctatgaggaactgagggagggacctgtgcactagggcgtaaattgcttgttgaaactgtgctgggtgtgcctgcatgccagacacccgatcttgcaagaccgtcattaaaagtctcactttcgctgttctctgggtctctgagttcattgtttgggtttagatgggtgaatttgtttctcacaaatttgattggattgaaggatgagagtattgatcctgggcgtatctgtgagggtgttgccaaaggagattaacatttgagtcaatgggctggggaaagcagacccaccctaaatctggtgggcacaatataatccactgcccatgaatataaagcaggcagaaaaacatgaaaaggcaagactggcctatcctgccagcctacatctttctcctgtgctggatgcttcctgccctggaacatcagactccaagttcttcagttttgagacttgaactgactttcctgctccttaagcttgcaggcagcctattgcgggacattgtgattgtgtaagttaatacttaataaactcctggctgggtgtgatggttcacacctgtaatcccagctctcagagatgcagaggcgggaggatagcttgagcccaggagttggagacctgcctgggcaatatagcaagaccctgttttccacaaaaagtaagaaaaaaaagtaagtgtaatacttaataaactcctttgtatatctatcctattaattctgtctctctagagaaccctgactaatacagagtcacataaaaatatgagcctcaggccaggcacagtgggtcacgcctgtaatcccagcactttgggaggccaaagcgggtggatcctgatcacctgaggttaggagttcgagaccagcctgaccaacatggagaaaccccgtctctactaaaaatacacaattaaccaggtatggtggcacatgcctgtaatcccagctactccgaagactgaggcaggagaatcacttgaacctggcaggcagaggttgcggtgagctgagatcacgccattgcactccagcctgggcaacaaaagcaaaactctgtctcaaaaaaaaaaaaaaagcctcaaagaaggccgtatggttgaagtttatatgcagcacataaaggactaactaggcttggagttcttagggggtggtggccacaggttatgggaggttgaggggaggaaagacatggtgagcaaaggctgtgttgtgatgcagatgtgatgcagatgaagtctctcaagaagcagccctccaccagatgtggtggctcatgcctgtaatcccagcactttgggaggctgaggtgggcagattatttgaggtcaggagttcaagaccagcctggccaacatggcaaaccccatctctactaaaaatacaggccgggctcggtggctcatgcctgtaatcccagcactttgggaggccaaggcaggtggatcatgaggtcaagagatcaagaccatcctggctaacacagtgaaaccccgtctctactaaaaatacaaaaaaattagccaggcgtggtggcgggcacctgtagtcccagctactagggaggctgaggcaggagaatggcatgaacctgggaggcagagtttgcagtgagctgagatggcaccactgcactccagcctgggcgaaagagcaagactctgtctaaaataaataaataaataaataagtaataaattaattaattaacctggtgtggtggtgggcacctgtaatcccagctgctcgggaggctgaggcatgagaatggcttgaacctgggaggcagaggttgcagtgagccaagattgcaccactgcacactccagcctgggtgtcagagtaagaccccgtttcaaaaaaaaaaagtttcctgtcagacctttaaaagcatgagatcttttgtttccttttcctgtgagttaatcttacctggatccagataaagcagataagaaggtctcagagaaagccatttgcagttgatgtttacttcctctacacatgctaatctccctgacaaaaggacagcttttcataggtatttctgtgactgtgttgcctattgcactgcctacatgacttacctggacccctacccagatgttgttggccattgcagtgcctatgtgacatggctgaattcttactcacctttaactctgcttatttttaagaaacaggatgtctgtggtcagaagtttcttcttgggactaaaccagctgaagctggtgaaatccatgatggcagcttacgcaacctctgaaaaacatctagctttattataatccaatttccatgctaaatagcactcccatcagtgcatgacagttgacaatcactgtgacaatgaacggaagagaccaagaaaggacagaaatgaggtgactccttgattctaggaaaatctccatcccttactaagaaaagcatgaatattcctcaccttgctcattcccttcattaaagatcctctatatttgtaacttcctggttctcagtagctgagaaggtgatttgcaagctatactacttctccaattccatgctatgctcctacttctccaatgccattgaatagagcctgcactgcttgacgctcactcttggtttcatacattggctttgcaataataaacaggaaagagtccctttttggggtgagacccctcagtaacatctgcagcccctctaaatagccatctcaaattataccaaaggagtgtattttggggtggcatattttgggcttcccacatggctaagccaacatatagcattcttgctgaacgcagggtgatcagacatcacctagcagatggtgaaggatgaggagccctattagatattatgagtgatcagctattgaagatggggaattctggctaaattgactgagaaggattcttgctgagattgaacaatgcagagaggaacacagaagctcaatagttgaggcctagtgagaagaggactcagaagagcctgattagtttggccaaggagatgtcaacctgaaataaatgaaaggttcagaattcagcgttaaaatgtttattcattctgcttgtgggaactaatggtaaaaattaaaaaagagtttattcaaacaaaaatctgggaatagccaatcagggcacacagactccagagaaatggggtcagtgctgcaaagtcaaaagtgaagttcttgcttacatagaaagaaaaaaaattaataggatcacaacattttctatataaggctgctttaagagttacaacaaattaattagttgcagaatttttttttttttttttgttattgttgttgttctgagatggagtctcactctgttgctaaggctggagtgcaatggcatgatcttggctcactgcaacctctgcctcttggtttcaagtgattctcctgtctcaacctcctgaatatctgggattacaggtgcccaccaccatgcccaggtaattttttgtatttttactagagatgggatttcaccatgtgaaccaggctggtctcaaactcctgacctcaagtgatccacccacctcagcctcccaaagtgctgggattacaggcatgagccccactgtgcccaacctttttctctttccatactacttgttttctttctttatagctggctcacatttcctttccaatttaaaggagtgtatttaacattgcatcttaagacaatgcaatagccatgaagtctttatgagagcaaggtaagaaggaagttaatctataatgaaagtcagcagtgcagagggaagcaatcttccctggcacccttcaataatttgtataacatgttagaaaacaatgcgtgtggctgggtgcagtggctcatgcctgtaatcccagcactttgggaggctgaggcaggtggatcatgaggtcaggagatggagaccatcctggctaacatggtgaaaccccatctctactaaaatacaaaaaattacctgggcgtgatggtgtgcgcctatagtcccagctactcgggaggctgaggcaggagaatggcatgaacccaggaggccaaggttgcagtgagccgagatcatgccactgcactccagcctggcccacagagcaagactccatctcaaaaaaaaacaaacaaacaaacaaaaaaaaaaccaacaatgtatgtaaggaagaaggccaatctataatcagagaaacaaaggttacaactgcctagtttacaggtgcctctcatgtgacttaggctccatactcacattttcttcttttttttttttttgagacagagttttactcttgttgcccaggctggagtgcaatggtgcaatctcagctcactgcaacctctgcctcccaggttcaagtgattctcctgcctcagcctcccaagtagctgggattacaggcatgcgccaccacacctggttaattttgtatttttagtagggatgggctttttccatgttagtcaggctggtctcgaactcctgatctcaggtgatctgcctgcctagggcctcccaaagtactgggattacaggtgtgagccatggtgcctggcccatactcacatttttttaaggctcacagtaatttggaattccaacaacttacattttaaattacttattttcacagaaagaatctttgtcagttgtaactcgcttatttctccaaagaccatagtcctgtccagtgatcctccccaagacaatagctctctctagtaactatagctttcctttcccatttcaatttccactccaattgactgaattgtgaacaccaactcccacacttaaatgttgaagccctaacccccagtgtgatggtttatgcagctggggcctttgagaggtaatcaggtttaaaagaggttatgagagtggggtcctcatgctgagattaatgccattataagaagagacactagaaagcttgctcatccgccttccccatggtgcacaaagaaatggtcacatgggcacacagtgaaactacagccacttacaggccgtaggaagagatcttagaaagaaatccgctttgctagcacctttatcttggacttcccaacttctagaagtgtgagaaacacatttctatagtttaagccacttggtatatggtattttgttatggcaacctgaacagacttatacaacaattaagtcctagaggcaatacaacttctctgctgattccagattctgagcgcctctcagtcctttgttgggttattttgatcctgtccatatatttagaaatattctcttcataaaactctctgtaggctgggtgcagtggctcatgcctgcaatcccagcactttgggaggccgaggcgggcagatcatgaggtcaagagatcgagaccatcctggtcaacacagtgaaaccccgtctctactaaaaatacaaaaaattagccaggtgtggtggcgggtgcctgtagtcccagctactccagaggctgaggcaggagaatggcgtgaacccaggagtcggagcttgcagtgagccgagatcatgccactgcactccagcctgggggacagagcgagactccatctcaaaaaagaaaaaaacctctctttaaatcacacattcgagtgtgccctttgtttctcatcaaagccaagactgatttgagatgatttcttaaggtcaggttaatgtcctaatccagttgtgctgctataacaaaataccacagagtgagtaacttataaacaacaaaaatttattgctcacagttatggaggatggtcagtctaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggccacaggtgctcaccaccatgcctggctaattttttttttttttttttttttttttggtagaaatggggtttcaccatgtttcccaggctggtctcaaactcttggactcaggcaatctgtcagcctcctaaaggagtgctgggattacaggcatgagccaccgtgcccaccccccaaattctactaatatatgtgcataattaaatagttaccagccatcattttctgatactttggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaagacctggaaagggattccctgtagcatgtagactttccccacaagagacaactttgtagggacatttcaaaatatgataacaaatatattttagggtaaaatatttttatttctttcagggcctgctatctgtcatgtaatgctacactagagtcaggctggaatttggtgtcttattgctacaaaaagtcttaagatctctgttgtaatgccagttgtgcctggtcggatgtgctggtcagttgtgcctgaattccaaaggaaggagggtataatgaggcctatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccgttttatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgtttgtttgttttgggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtcctcgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatatcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaaggagcttacagtgaagtagtctcaagcaattgctttcttttttttttcttttttttcttttattattatactttaagttttagggtacatgtgcacattgtgcaggttagttacatatgtatacatgtgccatgctggtgcgttgcacccactaactcgtcatctagcattaggtatatctcccaatgctatccctccctcctccccccaacccacaacagtcctcagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggggtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacttcgcaaaagaagacatttatgcagccaaaaaacacatgaaaaaatgctcatcatcactggccatcagagaaatgcaaatcataaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcagggatctagaactagaaataccatttgagccagccatcccattactgggtatatacccaaaggactataaagcaactgctttctaagtgggatggctgaagcaagagaccttaaatcacttgactgtcttcacaaaacagaactgaagcagaaccagaagtcccctgatagcctttcagggacaccacctacaaatacaccgtaatccctcatactccacacgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgtcaagactagacttaggcgttttatcctttttatgacattatgtatgttgaagagaatatatgaatatatataaaaccttcattatcacattattctcaatccagcattttctcagcccctgattttcatgttagttcagcattcttacatctttacagattttcatctaagactacatttctattgttttatataatcagcccccctaagatcaacatgtccacattttttggcaaagacaaagcctactgatttcaggatcattattttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaccagctaaaaagtcgcttaagctaagaaaccttcaccagcctcatgggaaattgtgtacagttttccactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactatataatattaaaattctgcatgtggcataaaacatattttaatggagaaggtaatgtgtagggagtttatttctgtttgctattagaacttgtgtttattcttggttaaaaaaactgcagattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttcttttaaatttaattaatcctcaatgtccttgtaaaatagccaaagggaaaatgtatttacattactctaaatattgatgcaatctacaaaaagtgttaaacaacttcctcaaagtaaataaaatgttcacaatccagctaggataaaaggatttaaatcatttcctaggtagagggctttcaattagagcccctgctgcattaaccatgggaactcatctcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttaatcacacttgtatataagagatcatagaaaaacagtttactaacctgtgaaaataccattcattctctgtttacctctggtccacagctaagcaatcagcaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaagggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtagagttaatattagcacatgaactgaaaatattaagtgattataaaaacgtccaaataaattcattaaaatttagcttggcaaaatgttagtttcatgttcttggtagaagtccttttatatttatattcaaatgaaatgaacaatttacaagcaaaggaaatggcatcaaatatttcacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgtaagtcaaaggatatgaaataatagtaactatacattaagcacagaagaaaatgaaacaaacaaaaaggttttaaaccaaccaaaaatatgtcttattttggatgttctatatgttcttacattctctcaggtcttttgtgtcattatgaacacaattctaacaagcttgattattttatttccattcacatattacaggcaacaagctgaaaaagtagaacggggtgtagagagacaggacaaagtacagattagggcttgaagtgcccctgaccagtcgacagcaaccacatggaataatgactcatgtgcattaatgatcacactaaatgatatttgtttttttacctagtccttcaactgacagcttaaagaacttcaggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccagggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccatacacttaagcaagctctggggaatgagagttggggggaatcaactcttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaatggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaggcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtggcttctccataggcagaaaactagcgtagtttttttattagaaattgttattcaataatagtacatgttacaaataaataccattttaaactgaaaaaattgtagactttcaaatcagttagggtggtcaccctaaaaaagggcattttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatataaatagagagatagtatgtagtaggaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcccgtgtaatgttccggggtttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggcaaagaaagtcaacaaaggaagttcatatgaaatcaaactagtaatatgattacaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaagtaaaaataaaatctgactgttaactacagaaatcatttcaaattctgtggtgataataaagtaatgaccacttttcagctggagggactaacttcttttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaacaaatgtgataccaataatcaagaattcactcagttaagattttgcccactgatttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcacgtgttacctaaagtggcatgtggttccctaaagcttaataactgacattgccttaaaaaaggggtttgcttcccgactaatgtggaaaaagtctgaaaaatgattttaaatctttcactaaatttctcatttggtcacgtggaggaaaatgatttcaccaaatagatactctcattaattttttaatgtaatttatcaaagaaatgaaatatttagataaattccagatttcccccaccatgagcttctccgaaagtatactccatcacagactgctcactaagaagctctactgcagtcaaagtgaccgaatttaaggggacataatgactacttctgctacacagaaacattatccatctctaacacttccctatgagatggaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtatgaaatgccaaatgccagttaaccaaagctttctttgtcataaagcaacttctataaaaattgctgaaaataaattcttcatggctcaatgtgaatcagtaatttccatctctattacactgttgtttacccaaaaactatttttaatgactaagactcagagtttgccagagtgttttccacaaaacaactgttttgagatactccagatctgtaatcaagtaagtctgaaaaaccccaaatacctcactcacctcttggatatgcataaagcacactaatatataacgttctaaaaagccaatcattaaaaccgttttatattgtttaagcatttcctagacatatttggctacaaatctaacatctaattaaacagtttgggaaatgccatcacataatgtaggaatattactagtcatttaagaaactagaaaatatttactatattctaggcagttggctagcagttggagttctagtctctaaacaaaatactgacttatttctgtgacttttttcttttaagcagctctgtgcttcacaatttttttttcctggtttgttttccacttttgtctgtactttattccttcacagatgtgaaaggctaacaaatgtaaactagttatatgaatcagcctctgcctcagttctacacttcaaatacagtatatactctatcaacaattcttggataataacaacctgtacttgttttacaaacaataaaacaggccgggcaccgtggctggctcacgcccataatcccaacactttgggagaccgaggtgggccgatcacctgaggccaatatggtgaattctcgtctcgactaaaaatacaaaataattagctggccgtggtggtgtgtgcctgtaatcccagttacttgagagactgagacaagagaatcgcttgaacccagggggcagaggttgcagtgagccaagatctcaccaactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaaagtttcaatagatgtctccctctaaaattaatattgaatgatttgtcatcttccatttaataccaaaagggtatcagccacaaactgaaatatcactcatatgcaaataaataacattcaagacttttgtcgttgtggttattaatcttgtaatggatggacataaatctattcacattctcatcctatcctcaaatttcactattctctcctctcattcttactttgttctactcatattctcactctatcctcctatgcataaaatattatgtatcctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcatgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatgggtaagaaactcaaaatcaagaattttaagacactgggttaaggtgattgagctaagtcaaagccaacagggcatgggctaaatattgacatgggatgggatgaagaggccaacaatgtttcaaagcagaggttgccggagcttcaggaaccagaagaggaagacttgaggtgaaatctgaaacagcaatccccatacctgtctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggggaacatgaaagatagaatttcagaaatttagagaatgaaaaaggaaagattacaaggcaataagttgattaaaatagactaaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcaggcactacctttgccaaccagcagattttcagtattgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcacccaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctcactaactcattcagctcccttcatactccctccccacagccaccccagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaacgctgaatggcttcaaaataactgcatatgccaagatttctggagtgggcacgtttgatcttctttcataatgaaaactgacaaacatttttaagggcatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccaggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgtcacactggattcatatgaaattccactgcaagtgacatcaccagattggggaccctgaagtgtttgagtatcttctccacatctggtcatttaggctaagaaattccttcttgtctaccaggtcttttagcattcattttgtaagtcattcaacacctacttactgagaaggaatactgggctagacagtgtgctaggggctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacatatgcaggcaactcacatcctgccaaatattaaatttctaattttattataatttctaataaaacattagatttattattatacagagtcatactccttgattgggaaactctcaactcaataaacattctttagtctcatgtcttttctaaaggaaagaaattaatgttatattcttgggtgaaaaaaatgtgaggtctcaaaagagtataatacaatttggggatgcatatatattttacatgtatatagacacataaaaatctaaaagcataaattttaatatgttaacagaagacagaagtcatgtattttttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttcccaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgattggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatatagaacaaaattatcgtgttttttttaatagtaacatgtaagatcaatctttgtctttaaaataccgtgtatctcattctcggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacagcaagattattttaagagtctgactgaaatgtcaggatgagaaatagattaataaatattggcttctaatgtcggtaatgaaaacaaacacgttattttcagaaaataaaaggtcttcgtcattaggtacaaatcataaagggattatctacggttactacactgtaacaactttttacatattgtattatagaacaagcttttgagaagacaaagcaacacatcagcagtttaaccaattgtctttctcttttaacaggctggtctacattagattagatataaaaggcccaggtattacttgtgttcgatcttagccacatggctgagaaacatccaggtacatttaaatcagtgacaaaagaaaacattatcccttagtaaaattacataaaataggaaacatctcttactttaagagcaacgatggtacttgttcctatggtgaaaactgatgttatctcgattagttaattattcatcccaacacctggtcttgcttccttttccacctctagctatgttaacactagagttcagtaatttgttgataaagaatcttaactgcagtatctaacagatcttagtgattaagcatatgacttaccctttgtacagataagtaaactgaggccaaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaagatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcagtgtgccaattctgggtcttaggcatattgtatatactggaatgatattcactttaattaaatttgttttgagatgtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcacaattggatttgggtttgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaaatatacagagaattggcaggctgcatgtttatgtgaaccttcagaaaacatggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagcaatctagtactgtagcagaaccgtttcaacatgaagagttctgctcatcgcctgtggcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggcgctccatttggtggagtcaggggaggcctggccgggcgggtggcgagggctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccggacgcagcttacgagcgcaacgcagcaggctccattcccggccgccgccgctcagcccattacgcaaacctggcgggtccaaccaaccccgctctgccgccgctgctggaacccatgaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggag
